United States Patent 7,833,706 (GENETIC POLYMORPHISMS ASSOCIATED WITH RHEUMATOID ARTHRITIS, METHODS OF DETECTION AND USES THEREOF) - sequence listing, part 14

SEQ ID NO: 46128 - DNA, 201 bp, Homo sapiens
agtttgtgcctagcatggtgctttgtgaactagtgagccccatgctgcagacaaggaaactgaggcttaaagaggtgaagtcatttgtccaagataacacytgcagtcaacccccggagcccatgctttttttttttttttttggacaccgagtcttgctctttcgcccaggctggagtgtactggcgcaatctcggctca

SEQ ID NO: 46129 - DNA, 201 bp, Homo sapiens
cagagcactccccacagggcttggtcctcacagagcactccccacagggcttggtatctcttcctttacctatttgtctccccaccggactgagctctgarcacctttctatgcagagctccgtttcactgtggagccaaacagatcttgttcctgcccttatggaattacgatcccaagggctctatttttatttttagt

SEQ ID NO: 46130 - DNA, 201 bp, Homo sapiens
actttttaatgtccctggacctagagagccgggaccaggcctggagcccaaagacctgtgacattgttatcgagggcagccagagccctaccagcccagcytctagctccccaaagccaggctccaaggctggctcacaggaggcagaggtgggtagtgatggtgaaagggtggcccagaccccggacagcagcgatggag

SEQ ID NO: 46131 - DNA, 201 bp, Homo sapiens
ccagacctggaatcccccttgagacatttgggccttatgctaagaacagtccttctagccactgcgacaatcaacaccttctatgtgctgggacttagggyaccacaggacaatctgcaaatcctgtaaatggttgatgacaggaaggccttctgaagggaaagacagcccatgcagaagaaagcatggcatagcacctag

SEQ ID NO: 46132 - DNA, 201 bp, Homo sapiens
tgccttgtaaaatgattctctaaactacacatttgctttgtgtgctctgtgttttgtttcacatgtttaaaatgttggctagagctgttctctgggtgctrtgggagcccaggggaggcacttaatttctgaggggagaggataaggaaaggtcctctgaaaggttattattgggagggtgagggtaggttgggatgaatg

SEQ ID NO: 46133 - DNA, 201 bp, Homo sapiens
ccatgcctggctagtttttgtatttttagtagaaacgaggcttcaccatgttggccaggctggtctcaaactcctgacctcaagtgatccgcccacctcgscctcccaaagtgctgagattacagacgtgagccaccacacctggcctgtttttcaattttattatttattatttttaataatgtatattcaatccacagt

SEQ ID NO: 46134 - DNA, 201 bp, Homo sapiens
aatacaaaaaattagccgggcgtggtggcgggtgcctgtagtcccagccactcaggaggctgaggcagaagaatggtgtgaacccgggaggcggagcttgyagtgagccgagatggcgccaccgcactccaacctgggcgacagagcgagactccgtctcaaaaaaaaaaaaaaagaaaatttccccaaacagtagggagg

SEQ ID NO: 46135 - DNA, 201 bp, Homo sapiens
gcatggatcaggtggtgcggaaaagactcaggtgttcctccagtggtttctaaaaaaatatttgtaacaggaaaataaatggctttctcttttctgcttaratcatcatgctcaggaacgacatttaccgctgccgagcgtcaggcatctttcttcgcttggagggcggtggcttgattgccggcaacaacatttaccaca

SEQ ID NO: 46136 - DNA, 201 bp, Homo sapiens
tcctgatgacctctcttgtgtgaaggtgaagtctgcagctagagccatcaggtggcttgtccgaggtcattagcaaggcagggactctctcccaggccagwggcttttgtttcccctctcagggagactcaggtgccgcttcacctgagttcagtgtcggtgaccagctcctctcactgtcccagctaacaagggctgtgg

SEQ ID NO: 46137 - DNA, 201 bp, Homo sapiens
caacaacatttaccacaatgcagaggctggtgtagacatccggaaaaagtccaacccactcatactggtactttgtgttcgttccctattcagggtgactyttggttttcagaaaccatttgtgaggatatttaaatacacgttgccctcttgtatttacgtgcttcctgtttgcaggtggctcctgctctgtcctctgcg

SEQ ID NO: 46138 - DNA, 201 bp, Homo sapiens
tttccggccaggcatggtggctcacgcccgtaatcccagcactttgggaggccgaggcgggtggatcacgaggtcaggagatcgagaccatcctggctaayacggtgaaaccatgtctctactaaaaatacaaaaaattagccgggcgtggtggcgggtgcctgtagtcccagccactcaggaggctgaggcagaagaatg

SEQ ID NO: 46139 - DNA, 201 bp, Homo sapiens
ctgggcttttaatccctttttttgttggaattgaaagttaagagttattattatactcatactcctctgagtgctgaaccagttgagaaacaggcacagtsatcagtagagttcagaattctgctttattcttggtaaagcagtatttaaaaatggcttgggcttggaaccaaaattcttttgcacctcttccctttccaa

SEQ ID NO: 46140 - DNA, 201 bp, Homo sapiens
aattggtttcttgaaaacaaagtaaattgggtgggtggggatgtgtgccagtggctcacacctgtaatcccagcactttaggaggctgaggtgggcggttygcctgaggtcaggagttcgagaccagcctggccagcacggtgaaaccccatctctactaaaaatacaaaaattagtcaggcgtggtggcaggcggctgta

SEQ ID NO: 46141 - DNA, 201 bp, Homo sapiens
gttttttaaaccctgggaaaacttataaggaagttttaaagtcagggaaaaccctgactttctctgtcttttaattagaacatttagtccattttcattamtagcaccactgatgtatttttgtttaggtctgccttattttatgctctcaatctgtttgtcctgacagttctccatttcattacagctgtcttcccttct

SEQ ID NO: 46142 - DNA, 201 bp, Homo sapiens
aagtgttttgttctttcagtttgccttaatgaatgaacctattcttgagttacctgtcatgggttttgtttgaaatgtctgctaatttctctcattaccctctttcttttagtttagtgattattagtttcccactcgtctaaaatgtttgatactgtatacataaaggaatgtacacaaagagacatttgattaagattt

SEQ ID NO: 46143 - DNA, 201 bp, Homo sapiens
agtgttttgttctttcagtttgccttaatgaatgaacctattcttgagttacctgtcatgggttttgtttgaaatgtctgctaatttctctcattaccctctttcttttagtttagtgattattagtttcccactcgtctaaaatgtttgatactgtatacataaaggaatgtacacaaagagacatttgattaagatttt

SEQ ID NO: 46144 - DNA, 201 bp, Homo sapiens
agtaaaatgtattctacagttattggattcaatgtccaatgaaatgccattagatcaagtttgttaatggtgttcaaatcttctttatccttactgggtgkttttttttttcctatgaattatagagggatgtgtttaaatatccaagtataattatgaatttgtctacttcatcttttaattttttttttttttttttgc

SEQ ID NO: 46145 - DNA, 201 bp, Homo sapiens
gtgttttgttctttcagtttgccttaatgaatgaacctattcttgagttacctgtcatgggttttgtttgaaatgtctgctaatttctctcattaccctctttcttttagtttagtgattattagtttcccactcgtctaaaatgtttgatactgtatacataaaggaatgtacacaaagagacatttgattaagattttg

SEQ ID NO: 46146 - DNA, 201 bp, Homo sapiens
tctcctccatttgaaaacactctttacggaaacaactgtacagatgcaagcagagaagagacttcactcatcatcccaccccagtaacacagcggcttttktgtttatgtgcccttccagtgaactccgtgtaggcgttctattcggcagtcactactgagcacttccaacatgggcaggctctgctccctgggagcttac

SEQ ID NO: 46147 - DNA, 201 bp, Homo sapiens
ttttttttccgagacagactttcactcttgttgcccaggctggagtgcaatggcacaatctcggctcactgcaacctccacctcccgggttcaagggattmtcctgcctcctcagcctcccaagtagctgggattgcatgcatgcgccaccatgcccagctaatgtttttgtattttagtagagacagggttttaccatgt

SEQ ID NO: 46148 - DNA, 201 bp, Homo sapiens
atagttttaagttttttaatttcatacatatagaatcatacttttgcattttgtgttttgcttcttttgctcaacttgtttgtgagatgcatccacgtggyggcctcacttattttcgttgccaacagtgtttcatggtatggctgtgtcacaatagatgtattcatcctgtggttgatggatacttgagttgcttatagt

SEQ ID NO: 46149 - DNA, 201 bp, Homo sapiens
tgttttgttctttcagtttgccttaatgaatgaacctattcttgagttacctgtcatgggttttgtttgaaatgtctgctaatttctctcattaccctctttcttttagtttagtgattattagtttcccactcgtctaaaatgtttgatactgtatacataaaggaatgtacacaaagagacatttgattaagattttgt

SEQ ID NO: 46150 - DNA, 201 bp, Homo sapiens
tctttatccttactgggtgtttttttttttcctatgaattatagagggatgtgtttaaatatccaagtataattatgaatttgtctacttcatcttttaattttttttttttttttttgctttatatctgtaaggccgtattatcaggtgcatatacaaatataaagttgttttatcttcttaattcttaattcttaattc

SEQ ID NO: 46151 - DNA, 201 bp, Homo sapiens
ggttcccctggtgtcctggagagttctcttttagggcatttggggcccttcctgctagcaaccttggtcatggtcatctagaccacccaagagatgtctcygttttcaaacttcttatcagagtttgtgggctcagtcccttctcttcttaaccttaacccaaatccctttggcaaattggttccacatactctccagggt

SEQ ID NO: 46152 - DNA, 201 bp, Homo sapiens
atgactttagattggtcagggggctcctgtggctatatgtaggaagggtttgatggggctattttgcattttaaaaataattttctttaaacttattcacrcacgcttgacgtcatgcccatcatctgatttggaaaggacagaaacgctttttctcatttcccagaaagagaggcccagagagagaacgtggcttactca

SEQ ID NO: 46153 - DNA, 201 bp, Homo sapiens
attccatgcttggttttccaaggttagagcttgtttcatttatgcttgcgtgctcagccattctccccaaagcacctcactctgggcttttgttgagcttktcaccaggctgggttcccctggtgtcctggagagttctcttttagggcatttggggcccttcctgctagcaaccttggtcatggtcatctagaccaccca

SEQ ID NO: 46154 - DNA, 201 bp, Homo sapiens
ggaaggaaacatcttccggaacctgacttacgcagtgcggtgtatacataatagcaaggtgctgtcatgactttagattggtcagggggctcctgtggctrtatgtaggaagggtttgatggggctattttgcattttaaaaataattttctttaaacttattcacacacgcttgacgtcatgcccatcatctgatttgga

SEQ ID NO: 46155 - DNA, 201 bp, Homo sapiens
tgtgagccactgtgcctggcctctgttagactctttatttttattttttgagacacagttttgcttttgtcacccaggctggaatgcagtgatgctatctyggctgcaacctcagcctccaaggtttaagtgattctcctgcctcagcctcccaagttgctgggattacaggcatgtgccaccacgcctggctaatttttg

SEQ ID NO: 46156 - DNA, 201 bp, Homo sapiens
cattttttaaattcccgttttgtcactttttctgataaaagatggccatattaccccttttcggccccatgtatctcagtaccccatggagctgggctaaktaaataggaattggtttcacgcctgaggcaattagacactttggaagatggcataacctgtctcacctggacttaagcgtctggctctaattcacagtgc

SEQ ID NO: 46157 - DNA, 201 bp, Homo sapiens
ctgacccttgacctgactcccagcccgggccccgcgccccaagcggcgaccccgcccgcgcagtccccggaagcgcgcccggtagtctcctgtgccccttyccccgcccggccgggcctggtggagcccaggctgcccgcctgcccgccctcggtccccggagcttcctctcccagcggcgccgggcagggcgggggcttt

SEQ ID NO: 46158 - DNA, 201 bp, Homo sapiens
cagctactcaggaggctgaggcaggagaattgcttgaacctgggaggcagaggttgcagtgagccgagatcgcatcactgcactccagcctaggtgacagrgtgagactcttgtctcaaaaaaaaaaaaaaaaaaagtttgaaaatttattcaccaaaagtggcgacagtcaatttattcaaattctatgtacctcaaact

SEQ ID NO: 46159 - DNA, 201 bp, Homo sapiens
cgctgaaagcgcgcgtggctgtcggagttgaaatgggaaagaaactctttacaactccattttgctttttacgtttaacgagaaacgacaatcactgtttratattgattaaagtccagttacactttgggtaggttttcttttaatgcagacttgttggagactgtgtaagtaagtaaaagattgtattgaacgcttagg

SEQ ID NO: 46160 - DNA, 201 bp, Homo sapiens
ggtctgtattgagtggaaaaggggtattttccatttggaaaaaaaaaacaacacacaaaactgtaaatgatttaagcgatgttgcatgaaaatagatgcaytgttgcttagtcgaagtcgctgtattgattaggaatgatctaaacatctgtaccttagttactgattggatctacagttacgggtcgtcttcattgaata

SEQ ID NO: 46161 - DNA, 201 bp, Homo sapiens
gcactctagcctgggcgacagagcaagactacatctcaaaaaaaaaaaaaaaaaagaaaaaagaaaaaatgtaaatactcctgtgttttactgttttagaycgtctgccatttcagtggtctgccatttcaatgtactatggtaagtgtcactttttctaaaagtgggtggggggattaaccttgcactcttgtggttgtt

SEQ ID NO: 46162 - DNA, 201 bp, Homo sapiens
accgctcccggccaaaagtcactcttcagccatttgaaataccagtaaaccccatagggtagaagttatgctgagagttgatgaacaagttagaaaaagarcatgtggaccctgggtcagctgctgccctagaatggggaccccttctgtaagctatgtcagaatcatctaccagcagtgacagatgtcctgtaaagtgcc

SEQ ID NO: 46163 - DNA, 201 bp, Homo sapiens
tgttccttgcctgtctttccccaaagaacttgagtttgaagtgattttcacttggcagtaaattgaaggttttcttcattgcttaccaccatgtgccttartcctgctgctcttgatctccaagtgcccttactgctacagaaaggaaagctcttgaactaagagcttggcagccacttgatcaggatggccaaataatgg

SEQ ID NO: 46164 - DNA, 201 bp, Homo sapiens
atttacctaagattacaaatcagaagtcatcttgctaccagtatttagaagccaactatgattattaacgatgtccaacccgtctggcccaccagggtccytttgacactgctctaacagccctcctctgcactcccacctgacacaccaggcgctaattcaaggaatttcttaacttcttgcttctttctagaaagagaa

SEQ ID NO: 46165 - DNA, 201 bp, Homo sapiens
tattaacgatgtccaacccgtctggcccaccagggtccttttgacactgctctaacagccctcctctgcactcccacctgacacaccaggcgctaattcarggaatttcttaacttcttgcttctttctagaaagagaaacagttggtaacttttgtgaattaggctgtaactactttataactaacatgtcctgcctatt

SEQ ID NO: 46166 - DNA, 201 bp, Homo sapiens
catgtttattagagattttatgtttggtagggggtagttaccatatgtcagtttaaaaatttcataagtttagcagtttgttgttttttttttttgttttkttttttttgagaaggagcctcactgtgtcgccaggctggagtgctgtggcacgatcttggctcaactgcaacctccgcctcccagatttaagcgattccc

SEQ ID NO: 46167 - DNA, 201 bp, Homo sapiens
aaatcagaagtcatcttgctaccagtatttagaagccaactatgattattaacgatgtccaacccgtctggcccaccagggtccttttgacactgctctawcagccctcctctgcactcccacctgacacaccaggcgctaattcaaggaatttcttaacttcttgcttctttctagaaagagaaacagttggtaactttt

SEQ ID NO: 46168 - DNA, 201 bp, Homo sapiens; identical to SEQ ID NO: 26335

SEQ ID NO: 46169 - DNA, 201 bp, Homo sapiens
ttgagcatttcagttatttctggcttcttcatgaccaccacttcctttgtgttggtggcactctttggctagatcactgcccctctccattccatacactygaagactatgctgtttttacctgtaataacagcttacctgggcactgatatttttcagctgactgtggggaaatgtttgtgaggtttggaaaacgcctcc

SEQ ID NO: 46170 - DNA, 201 bp, Homo sapiens
ggaatttcttaacttcttgcttctttctagaaagagaaacagttggtaacttttgtgaattaggctgtaactactttataactaacatgtcctgcctattwtctgtcagctgcaaggtactctggtgagtcaccacttcagggctttactccgtaacagattttgttggcatagctctggggtgggcagttttttgaaaat

SEQ ID NO: 46171 - DNA, 201 bp, Homo sapiens
tcccacctgacacaccaggcgctaattcaaggaatttcttaacttcttgcttctttctagaaagagaaacagttggtaacttttgtgaattaggctgtaaytactttataactaacatgtcctgcctattatctgtcagctgcaaggtactctggtgagtcaccacttcagggctttactccgtaacagattttgttggca

SEQ ID NO: 46172 - DNA, 201 bp, Homo sapiens
tacagttctgtggtttcatgttagttaccttatagttactgtgtaattagtgccacttaatgtatgttaccaaaaataaatatatctaccccagactagawgtagtattttttgtataattggatttcctaatactgtcatcctcaaagaaagtgtattggttttttaaaaaagaaagtgtatttggaaataaagtcagat

SEQ ID NO: 46173 - DNA, 201 bp, Homo sapiens
actatgattattaacgatgtccaacccgtctggcccaccagggtccttttgacactgctctaacagccctcctctgcactcccacctgacacaccaggcgstaattcaaggaatttcttaacttcttgcttctttctagaaagagaaacagttggtaacttttgtgaattaggctgtaactactttataactaacatgtcc

SEQ ID NO: 46174 - DNA, 201 bp, Homo sapiens
cgacagagcaagactacatctcaaaaaaaaaaaaaaaaaagaaaaaagaaaaaatgtaaatactcctgtgttttactgttttagaccgtctgccatttcartggtctgccatttcaatgtactatggtaagtgtcactttttctaaaagtgggtggggggattaaccttgcactcttgtggttgtttttcccattacaggt

SEQ ID NO: 46175 - DNA, 201 bp, Homo sapiens
aaataacccagtgacataggtcatattgccacttttcagaggagaaaactgaggctcaggagggggagttgacatgcccaagctcccttgagctcagatcrgcttgactcaatgtccaacattcccttggtagctttttctccggggtcctgtgctataagaacttctctctgcactgtatttttttttctcccaattctt

SEQ ID NO: 46176 - DNA, 201 bp, Homo sapiens; identical to SEQ ID NO: 33280

SEQ ID NO: 46177 - DNA, 201 bp, Homo sapiens
aagtccaagggtggcagccaatgagcagctctgctgggctgttacccagcagcctctgctgccagggccctccagtctgtaaccccttgggagttggtaaktggggagtcaggcccccagggaaaaggccattctgccctcaaatgccctccttggctctacttaagaccccaaggagcactctgtccagccttccagtct

SEQ ID NO: 46178 - DNA, 201 bp, Homo sapiens
  misc_feature (1)...(201): n = A,T,C or G, or insertion/deletion polymorphism (see Tables 1-2)
ggtggggcgggccccactggatgtgccagggaccaggaccaggccacgctgggccagagctgtcatggttcaggccttgcacacagaaccacagaacatgntcaacaagccccctaagcttaggggcactgacctaccctggggaccagtaatcttcaaggtagggcgcagaacacctgccatggaccaatggagtgttca

SEQ ID NO: 46179 - DNA, 201 bp, Homo sapiens
  misc_feature (1)...(201): n = A,T,C or G, or insertion/deletion polymorphism (see Tables 1-2)
cccctgcactgaccccaggccctccagagaggtgctttctggggtgcgtcccccacccccgccgcctctgttcacatacccattgttgtcaccattgaccnggagagcacttcctgcccaccccccacccctgccctgcactgggtgctggggacatggggatgagtcagaccccctactaccatttcctcccctgcctgg

SEQ ID NO: 46180 - DNA, 201 bp, Homo sapiens
  misc_feature (1)...(201): n = A,T,C or G, or insertion/deletion polymorphism (see Tables 1-2)
cgctgggccagagctgtcatggttcaggccttgcacacagaaccacagaacatgctcaacaagccccctaagcttaggggcactgacctaccctggggacnagtaatcttcaaggtagggcgcagaacacctgccatggaccaatggagtgttcaccaggccaggcacaatcttacctaatcaccccagaaaccctgggac

SEQ ID NO: 46181 - DNA, 201 bp, Homo sapiens
gacctcctcctgccctctggaggcagagatgttggtccctgacaggtagccccctcaaccccaaggtactggtggcagagtagggagctgggggctaggtrtccactctggctaactctggccaactcccttctctctgagcctcagccagcgccattcccctccccttacccatcccacagccgggaagggtggctttca

SEQ ID NO: 46182 - DNA, 201 bp, Homo sapiens
ttgatggttaaaaaatcacattggaagcccctgctctggtccaacccacttacttaccctgggaggggaatgaggccagagaaggaagtcaccagtccagrcacccatcagcttcagaaggggcgaaatcccaggcctccctcctccagccctggtggggctccagaggccgggcagaggcccactaaactccaagtggtc

SEQ ID NO: 46183 - DNA, 201 bp, Homo sapiens
tgccaggcacagacggtcaccccactctcagtggtccagcctgcaccagaactctgaggtcctggcaggattctcagacactgccctgtcccgtgcctgcmctggctctggagtccaaagcccccttataccatggcccggttacctgctggaagccagtgcatcctgcccggtgggtcccctctctgcaggccctgtgcc

SEQ ID NO: 46184 - DNA, 201 bp, Homo sapiens
  misc_feature (1)...(201): n = A,T,C or G, or insertion/deletion polymorphism (see Tables 1-2)
agcgaccccccaagctgggccagatcggccgagccaagcgaggtacgcggcccgggcccggagtcgccgcctgacccagaaaccctccgccgggcgccccncggctgccgttccccgccgagtgcccgcagctcttgccgcagaccagcgcaccagccgctctccagcccgggctggaggggggggtccccgctgcagtgt

SEQ ID NO: 46185 - DNA, 201 bp, Homo sapiens
gccgcctgacccagaaaccctccgccgggcgccccccggctgccgttccccgccgagtgcccgcagctcttgccgcagaccagcgcaccagccgctctccrgcccgggctggaggggggggtccccgctgcagtgtgtgtccccctcttcccttctcccgggaacacggtgccccggattcgatgctcgccacctctggaa

SEQ ID NO: 46186 - DNA, 201 bp, Homo sapiens
gtgaggaagttctaagattgagagatgtgtctaataccatatagctggtagaaagtcactgaagcttaaatacaggttttccaattcagagttctttctcraggtgatttagagagcatatcagaattatgttttaccatgctgctatatttttgtagcatttagctgagaaataaaatttataccaatctcagttctagt

SEQ ID NO: 46187 - DNA, 201 bp, Homo sapiens
aaaactcacttccatgaagccatcccagtttactaccacctttctctagttactttatttcagaaactttcaacatcatattaatatttctgtgtagtgcaaaaaaaaaaagcctgtttatattaccctataaactatacattaaaacattcagagattatgaccttttctttcctaactaactctccacagcaaccagat

SEQ ID NO: 46188 - DNA, 201 bp, Homo sapiens
gacaacggttgaagtgtgtgtgtggcgtcttcctgagcacgagtacagatcagttttctcctgtactgcctgacattgcaagttcttaagtgctgttagcygagctgtgcaaggccggtccgattctggctggatttgatcatggcagggaagtttcatttggctcgacagtggggaagaatttcagatcagtcttatctg

SEQ ID NO: 46189 - DNA, 201 bp, Homo sapiens
tggcatgggaaaatgtaaaggatagaaagtgcaaatatagaggagtggaaaagtacctgagaaaccattttaaaaatgtaaatgccaggttaaggagtttmgagtatgtatggtaggctatgtataaaattcattgatttttttttttttttgttttctattttttaaatagggctgattcctccacctaaattgttagca

SEQ ID NO: 46190 - DNA, 201 bp, Homo sapiens
tagaggagtggaaaagtacctgagaaaccattttaaaaatgtaaatgccaggttaaggagtttcgagtatgtatggtaggctatgtataaaattcattgatttttttttttttttgttttctattttttaaatagggctgattcctccacctaaattgttagcagtgtgaaccaactcattgtgtatgtgagaccataatt

SEQ ID NO: 46191 - DNA, 201 bp, Homo sapiens
gaaaagtacctgagaaaccattttaaaaatgtaaatgccaggttaaggagtttcgagtatgtatggtaggctatgtataaaattcattgattttttttttkttttgttttctattttttaaatagggctgattcctccacctaaattgttagcagtgtgaaccaactcattgtgtatgtgagaccataattgatttgggat

SEQ ID NO: 46192 - DNA, 201 bp, Homo sapiens
attgatttttttttttttttgttttctattttttaaatagggctgattcctccacctaaattgttagcagtgtgaaccaactcattgtgtatgtgagaccrtaattgatttgggatttttcttgtgatagaggtagttttaaactagggagacatgaattccaattttaattgagtatttactgatgtctgtacttggctc

SEQ ID NO: 46193 - DNA, 201 bp, Homo sapiens
  misc_feature (1)...(201): n = A,T,C or G, or insertion/deletion polymorphism (see Tables 1-2)
acctctgaatagccggttctcgcaccgcctaccgctttaaggagagttacgcgaaaggagtcctccattaattggatggtcttattatttgaagtgaggangccgaaagggaaggcagtttaggacaacggttgaagtgtgtgtgtggcgtcttcctgagcacgagtacagatcagttttctcctgtactgcctgacattg

SEQ ID NO: 46194 - DNA, 201 bp, Homo sapiens
agtcattctaatcattgttttcacacactatggaaatcattagaataaaaatgttgaagattgatttaaaatgaaagtttccaagttttgttatataatayttagcattttaaggtaagaaacaatagaaatttgattatgaagacttttattaaattacagtgtattacagattatatcataataataagcctttcatct

SEQ ID NO: 46195 - DNA, 201 bp, Homo sapiens
ttttctgattttgggggttgaggagtggaaagggtcatgtgttctttataaagtaacaaaagaatctgtggcaaggtacaacttacctacaaacaacgcargccaatcccatctccatggcaaaatcatcagcactggtctcctcaaaactggaaaggtcagccataggtaaatccttgctactttggacagtaatgggag

SEQ ID NO: 46196 - DNA, 201 bp, Homo sapiens
tcttgttttatctatattagaattagataaaactaaaaagagaaaaatgcacataacatggtctggtctttagcaatagaaatattaatcacatgtacatrctatacatataaataaataatcagcttatattatttattttttcaatatcttaaatattcaaatctttgttttgaaagcacataccaacaaaaacattga

SEQ ID NO: 46197 - DNA, 201 bp, Homo sapiens
taatgatataaatgttccctttctacctaatataatagtagtaaagtcttaatttctaaaatatagccatttagtatataaagtttctcattaaatttttwatcaagcaactattttttagtcaactaaactttaagatataatcttagataaaaatagaatctactataccttgacttctgttctcttaaacgctagaaa

SEQ ID NO: 46198 - DNA, 201 bp, Homo sapiens
aaactacataaaccatttattcctagaggaatatataccagcaatgagagaaaaagttagtcaagaagtaaacctttaattttcagttatgaaagacctawttttttttccttttcttgctattaaacataaaactgtctgccatatggttaaatgatctttcaaaaaacttcacaaaagaaaacccacctttagtaatta

SEQ ID NO: 46199 - DNA, 201 bp, Homo sapiens
gatctctgaggcatagattaaagtttacactcaaagttactatactccctaggactcaaatatttattgacaataacttttaaccacttaactttaaaatytgtaaattttactcattttttgaaaagtcaaaatctatagctatcaatatatattcactgagtgttgattattatatacctatacccattattatataaa

SEQ ID NO: 46200 - DNA, 201 bp, Homo sapiens
caatgaatacatgctcttactgataaattagatattatttgcaaagcagataaaagaataaacagtatcccagatgaagagaagaagctgagaagcagaamatatgggaacatgaaagttctccacatattcagggaatgacacacttagtctgtgtcagagtggccagagtgtatgaatgtgtatgctgaagcagtgaga

SEQ ID NO: 46201 - DNA, 201 bp, Homo sapiens
tttgaaaagtcaaaatctatagctatcaatatatattcactgagtgttgattattatatacctatacccattattatataaaagaaataggcataaaacaytgtttctttctgcttatggaacaactaatttactttcttttaacaagattaaaataaaatcttactttatcagcaggtctcttttcagcttccttcttta

SEQ ID NO: 46202 - DNA, 201 bp, Homo sapiens
ggcgtagtgctgttattggaacctattttggaacctattccacctttggatgatgttgccagaccagtcaaacccacaggtttctggttagctgacgaagyagcaggtttcccagtattgttttgtgttgttgaactcaattttgctgttgaaggaccagcagaggaagttttggctgcaaaagctgcccatccagttaag

SEQ ID NO: 46203 - DNA, 201 bp, Homo sapiens
cttgatctatttctgttccacttcgtcttctaccatcttgccgactttcctgagcaactgctttgtcgactctctctacctgaccaattgccagatcgacmacctgactggcctgaccagccactcctctgtctggaattaaaagatgtttccatcataatattctttaatttcaggtaatttagctggcactgagagtat

SEQ ID NO: 46204 - DNA, 201 bp, Homo sapiens
actataaacaattatggatatgtattttttggtttctttgaccccaaagggaaattggggtttatgtcaaattgatgttttatcaaaataaatctgtttckcaaagcaaaagtctctgtaggattgagataattcattatttacatatagggtaaacagacatttactgcctattgagatcataattgagataatggatta

SEQ ID NO: 46205 - DNA, 201 bp, Homo sapiens
atgttgccagaccagtcaaacccacaggtttctggttagctgacgaagtagcaggtttcccagtattgttttgtgttgttgaactcaattttgctgttgarggaccagcagaggaagttttggctgcaaaagctgcccatccagttaagccactagttactgacgaggaaacgctggcactagaagaatttcctgaaataa

SEQ ID NO: 46206 - DNA, 201 bp, Homo sapiens
taatgattccaaaagaaaatatatgaaattcctttttgggaattgcttttagattcaattctaagctatatctgaaaaccagatttagtgctttaacatastttttacccaacaaagtattatcgaccttagttaaacatctaattcttttagacttttctccaaataactagggatcatttcaaaaatttaattcactct

SEQ ID NO: 46207 - DNA, 201 bp, Homo sapiens
aataataagcctttcatctttaggctaatatgatacaaaaacctacttggccacattacttcttgagtttcttttgggcagctttcttcttgaccatctgyaatcgcttcatagcattgagctgtgattcttgtgaagttgggcctttaagggatgctgagggagagctgctggattctgaagtagttttgctggtagtac

SEQ ID NO: 46208 - DNA, 201 bp, Homo sapiens
ggggctggtttctgcggtggtttctgagttttttgagcctgcaaaaatcagtggattaaatcagatacaaaatcttaactgaatatacagaaagataatartccctcacaggactcatcactgaaatgaaatacagttgaacattttaaaaaatagtgtgatgataatgaatatatatgctctttgacaaattattatcat

SEQ ID NO: 46209 - DNA, 201 bp, Homo sapiens
ttcctggaactaaactacttggactaggaagacctactttgctgacattgtcacaactaactgagcgactaaggccagttttacccaaggttagaggtggrggtggttttaaaggtacagtgggcgtagtgctgttattggaacctattttggaacctattccacctttggatgatgttgccagaccagtcaaacccacag

SEQ ID NO: 46210 - DNA, 201 bp, Homo sapiens
taaagaaaaatatgattcctaccattcttttcatttgtctggtacatcgggcacaataccacaccaggcgagggtcattcgcttccttgtctgtcacctgsggtttatgacaatctcggtggtagagattatggcactcctgacattctactaattgattgccagatgccaccatcatttgcctaagaaaacataccatta

SEQ ID NO: 46211 - DNA, 201 bp, Homo sapiens
gtcctgacgacaatggaagcgtcccttttgaaaccgtcctagattctgccccatgtgtctcttcctttggctgattttaatctgtctcctttccaacatawtaaattgtagccatgagtattttccgtgaattctgtgagtccctctagagaattacgagcctgagggtcgttttgggaaccctccaaacatgcagttgtc

SEQ ID NO: 46212 - DNA, 201 bp, Homo sapiens
tgttttcgagactgagccttgctctgttgcttaggctggagtgcaatggtgcaatctcagctcactgcagcctccagctccctgattcaagtgattctccygcctcagcctcctgagtagctgggattacaggcacccaccatcatgcccagctaatttttgtattttttttttttgtagacttgaggttccaccatgttt

SEQ ID NO: 46213 - DNA, 201 bp, Homo sapiens
atcaatgctatgtaaagataagatctttacccttaaaacatttaccattaacccgggaaaacagaaaacaaacagtctttaattgatgccagcacaaagarctagagtccttgtgcaaaatacaaagaccttctggaaatggcaaaggaaggaatgaattcataaactttaaagtgtgctcagaggggtcaggacaagcac

SEQ ID NO: 46214 - DNA, 201 bp, Homo sapiens
gcaagtaatcaaatgttcaaaaatcaatgctatgtaaagataagatctttacccttaaaacatttaccattaacccgggaaaacagaaaacaaacagtctytaattgatgccagcacaaagagctagagtccttgtgcaaaatacaaagaccttctggaaatggcaaaggaaggaatgaattcataaactttaaagtgtgc

SEQ ID NO: 46215 - DNA, 201 bp, Homo sapiens
cctgaacattttcttagtacctttgttttatacttggaggactgaggcctgaataacttgtctcacatagcaaggtagtcagtaatggagtaagtttccarctggtttattggagacttactggttcattggagactcactccaacaaattttcacttaatttcctagcaatataatttatgaattatcaatattaaaata

SEQ ID NO: 46216 - DNA, 201 bp, Homo sapiens
cgcgatctcagctcactgcaacctctgcctcctgggttcaagtgattctcctgccttaccctcctgagtagctgggattacaggcacccgccaccacgccyggctaatttttgcatttttagtagatggggtttcaccatgttgaccaggctggtctcaaactcctgacctcaggtgatccacccgcctcagcctcccaaa

SEQ ID NO: 46217 - DNA, 201 bp, Homo sapiens
gattaaatttttggtttatagagcaaagaattcagaaacttatattaaggatgaagatcttaagaagatgagattcccctccgtgcccttctgtgcacacrcagagatccaaagccttttccatagctgcctgacaggtttcactgctgccctgaagaagtccttgagacttgcagcaggagaaggatctctgtataatct

SEQ ID NO: 46218 - DNA, 201 bp, Homo sapiens
atgttctcactgatatgtgggagctaagctatgaggatgcaaaggcataagaatgatacaatggactttggggacttggggggaagagtgggagggtggcragggataaaagactacaaatatggtgcagtgtatactgctcgggtgatggatgcaccaaaatctcacaaatcaccactaaagaatttactcatgtaacca

SEQ ID NO: 46219 - DNA, 201 bp, Homo sapiens
tctaagtgaagtaactcaggaacagaaaaccaaacatcatatgttctcactgatatgtgggagctaagctatgaggatgcaaaggcataagaatgatacartggactttggggacttggggggaagagtgggagggtggcgagggataaaagactacaaatatggtgcagtgtatactgctcgggtgatggatgcaccaaa

SEQ ID NO: 46220 - DNA, 201 bp, Homo sapiens
atggaatactacgcagacctaaaaagaaatgaattatcagtgtttgcagtgacctggataagactggagactattattctaagtgaagtaactcaggaacrgaaaaccaaacatcatatgttctcactgatatgtgggagctaagctatgaggatgcaaaggcataagaatgatacaatggactttggggacttgggggga

SEQ ID NO: 46221 - DNA, 201 bp, Homo sapiens
tatatatatatgatggaatactacgcagacctaaaaagaaatgaattatcagtgtttgcagtgacctggataagactggagactattattctaagtgaagkaactcaggaacagaaaaccaaacatcatatgttctcactgatatgtgggagctaagctatgaggatgcaaaggcataagaatgatacaatggactttggg

SEQ ID NO: 46222 - DNA, 201 bp, Homo sapiens
ggtgacgagagaaactccgtttcaaaaaaaaaaaaaaaaaagaacaaaaagtagaactatgatttgatccagcaatcccactactgggtatctacccagargaaaagaagtcattacatcattacaccaaaaagatacttgcatatgcatgtttacagcagcacaatttacaattgcaaaatcctggaaccaacccaaatg

SEQ ID NO: 46223 - DNA, 201 bp, Homo sapiens
ggatcacctgtggtcaggagttcaagacaagcctggccaacatggtgaaaccccatttctactaaaaagtaaaactagcctggcgtggtggtgagtgccttgaatcccagcttctcgggaggctgaggcaggagaattacttgaacccaggagccggaggttgcagtgagcagagatcatgccattgcactctagcctggg

SEQ ID NO: 46224 - DNA, 201 bp, Homo sapiens
gcacctaacactggagctccaaaatttataaaacaattactattagacctaagaaatgagataaacagcaacacaatagcagtggaggacttcaatactcygctaacagcactagacaggtcatcaagacagaaagtcaataaagaaacaaaggatttaaactataccttggaacaaatggacttaacagatatatacaga

SEQ ID NO: 46225 - DNA, 201 bp, Homo sapiens
tgttcaacaggaagctatcacaatcctaaacatatatgcacctaacactggagctccaaaatttataaaacaattactattagacctaagaaatgagataracagcaacacaatagcagtggaggacttcaatactctgctaacagcactagacaggtcatcaagacagaaagtcaataaagaaacaaaggatttaaacta

SEQ ID NO: 46226 - DNA, 201 bp, Homo sapiens
gttttcgagactgagccttgctctgttgcttaggctggagtgcaatggtgcaatctcagctcactgcagcctccagctccctgattcaagtgattctcctrcctcagcctcctgagtagctgggattacaggcacccaccatcatgcccagctaatttttgtattttttttttttgtagacttgaggttccaccatgtttc

SEQ ID NO: 46227 - DNA, 201 bp, Homo sapiens
tcttgaactcctgacctcaggtgatccacccgcctcagtctcccaaagtgctgggattacaggcgtgagccactgtgcctggcctgtttttgttttttctwtatcagaattttaaagagagaagaaggtggacttctggttaaggatgggagacacacacatttgtatttgtttcctcatgaaattttattaaaaagacag

SEQ ID NO: 46228 - DNA, 201 bp, Homo sapiens
acacaaaacattggcagccaggcctaaactccgtatacaagagactgactgtgagatccatctctagagaatggacagtttcataaggaacaacttaaagrtactgacattgaagtttccctagtaaaatggctcattacaaatgtccactgtgagcttctcagtggacaagtccgtctacagtctcagagcttctaatga

SEQ ID NO: 46229 - DNA, 201 bp, Homo sapiens
gtggaggggagaagcagggttggggccttgaaggtactgctgagcatgtgggtccttatccttaccctgcattgcccgcaggcctgacctttgcttcattyttcatggctgccaagtgagagtgtggcccctgcaggtaagatctaactaagtcttggatgtctctgtatctcaccgggtaggcagatagtaaaagctcaa

SEQ ID NO: 46230 - DNA, 201 bp, Homo sapiens
actaacatggagaaaacgttagatggggagaaaaaaaatctaacaattataattaatattttcacagaaataaaagaaaatattgcatccatgagataagmacagctaaagaacattcggagaatgcacacaaacactctctcggaaattaaaaaaaccatagttgagataaaaacacaatggaaggtttagaagacaaag

SEQ ID NO: 46231 - DNA, 201 bp, Homo sapiens
tcatctcatacgcctggatgtaggagacactctcccctcccacacacattctgattaaatttttggtttatagagcaaagaattcagaaacttatattaargatgaagatcttaagaagatgagattcccctccgtgcccttctgtgcacacacagagatccaaagccttttccatagctgcctgacaggtttcactgctg

SEQ ID NO: 46232 - DNA, 201 bp, Homo sapiens
aaatagtgaaagtgaccttctataataattatatcacatttgactctaggataatttacaatgttttcctcaccagaattattaaaaagcagtaccaactsttcacatctaataagctagtttcaagggagagctatgtcctgataacccaagaaataacaatcttaaaccctaaattatttgggaaaaaaaagcgaaact

SEQ ID NO: 46233 - DNA, 201 bp, Homo sapiens
aggaagtgtctgagtcaatgtgaaactggaaagaagagagatatggtttggctgtgaccccactcaaatctcattttgaattatagctcctacaattcccrtgtgtcgtgggagggacccggtgggaggtaattgaatcatgggggcgggtcattcccatgctgtttttgtgatcgtgagtctcacaagatctgatggttc

SEQ ID NO: 46234 - DNA, 201 bp, Homo sapiens
ttattcacttgatagataacttctaagtatttcaacatagcttatgggccttcattggtactcttgaatgtgaatagcgtgtctattgaatatttctcaaygtgtgttctgaggaccccatgcagcagaattcacgtgggttgtttgcttaaaatgcaaattcctgggtcccgtttttgattatcctgaatcagaattttt

SEQ ID NO: 46235 - DNA, 201 bp, Homo sapiens
gccattctagggaatctggagtgggcccgggcttgaaaaccagcagtgatgaatggtagaattctgtttggccagatcagatttgaaaataattttgaatrcctttggataggaaattcagctccaatgactcatagacctgtggtgtaaggcctgaaattaagattcaaaactaagtgctgccttgaccatggaggctgg

SEQ ID NO: 46236 - DNA, 201 bp, Homo sapiens
gaagatcttaagaagatgagattcccctccgtgcccttctgtgcacacacagagatccaaagccttttccatagctgcctgacaggtttcactgctgcccygaagaagtccttgagacttgcagcaggagaaggatctctgtataatctttgtttgcctaataatagggctttaagggtttttaaaaattggtttcctttg

SEQ ID NO: 46237 - DNA, 201 bp, Homo sapiens
ccatagctgcctgacaggtttcactgctgccctgaagaagtccttgagacttgcagcaggagaaggatctctgtataatctttgtttgcctaataataggdctttaagggtttttaaaaattggtttcctttggggatcatttaaatttcccatttccttgtaaatatttttggtaaaaacattatcctcttggatttcag

SEQ ID NO: 46238 - DNA, 201 bp, Homo sapiens
gcaaaccaaacacatcctcttacaggaaccaggggcacctcgccctcttgttactacaaagcctgcctcccacagctcctggtggttcactctgttcccarctgcaacccccacgtggctctctgtggggcagtgtcgtccttccctgggccatgagcatatgtgactaattacctgctgcccatctcatctgtctaggct

SEQ ID NO: 46239 - DNA, 201 bp, Homo sapiens
cgtgatctctgctctgggtcagggagcatgtccctgaggaaatgggcgggggctgaggcttggtgagtgaggcggaatactcaagcctggtgccggggagsagagcctggcagacagagctctgggtagagtctgggtagagggacctgtggtgggagaaagagagaagatcagagtggaggggagaagcagggttggggc

SEQ ID NO: 46240 - DNA, 201 bp, Homo sapiens
gttcactctgttcccaactgcaacccccacgtggctctctgtggggcagtgtcgtccttccctgggccatgagcatatgtgactaattacctgctgcccayctcatctgtctaggcttggatgttgtacattcaaccatcctctcaactctagggcggaatccctccctcaccagtggggtgaagtggaggcaaactaaat

SEQ ID NO: 46241 - DNA, 201 bp, Homo sapiens
atgttcctgaggaggaagacctcacatttcaatacaatattgaatataaatggtctaaatgctccatttaaaagaagaaccacagaatggataagaactcrccaaccaactctctgttgccttcagaagactcacctaacacataaggattcacataaacttaaagtaaaggggtggaaaaaggcatttcatgcaatggac

SEQ ID NO: 46242 - DNA, 201 bp, Homo sapiens
aatgttcctgaggaggaagacctcacatttcaatacaatattgaatataaatggtctaaatgctccatttaaaagaagaaccacagaatggataagaactygccaaccaactctctgttgccttcagaagactcacctaacacataaggattcacataaacttaaagtaaaggggtggaaaaaggcatttcatgcaatgga

SEQ ID NO: 46243 - DNA, 201 bp, Homo sapiens
ggtgctttggaaagtctcagcaatagaattgaacaagcagaagaaagaaattcagagcttgaagacaaggtcttcaaattaacacaatccaacaaagaccwagaaaaaagaataataaaatatgaacaaagcctccaagaagtctgggattatgttaaatgaccaaacctaagaataatcaatgttcctgaggaggaagac

SEQ ID NO: 46244 - DNA, 201 bp, Homo sapiens
aggtgctttggaaagtctcagcaatagaattgaacaagcagaagaaagaaattcagagcttgaagacaaggtcttcaaattaacacaatccaacaaagacmtagaaaaaagaataataaaatatgaacaaagcctccaagaagtctgggattatgttaaatgaccaaacctaagaataatcaatgttcctgaggaggaaga

SEQ ID NO: 46245 - DNA, 201 bp, Homo sapiens
ctggagctggctagactcactgggtggctagacccagaaaagagacaataatcactgcagtttggctcacaggaagccacatccacaggaaaaaggggggwgtactacatcaagggaacaccccatgggacaaaagaatctgaacaacagccttcagccctagaccttccctctgacagagcctatccaagtgagaaggag

SEQ ID NO: 46246 - DNA, 201 bp, Homo sapiens
ctacagctgatgctttctggaaagcaccacctcctggcaggaggccaaccagcacaaaaatagagcattaaaccaccgaagttaaggaccctcacggagtmcattataccctcctccacctccactggaacaggtgctggtatccatggctgagagacccacagacggttcacatcacaggactctgtgcagacaacctcc

SEQ ID NO: 46247 - DNA, 201 bp, Homo sapiens
cctgaggtcactggcttggcggtagcggcaggggtggcagaggtggaactgcagagttgcagggtccactgacccttaccctcagctggagaataaccctmcagatcaactgcaagaacaaaccagcaatcctgagaggagccgcagaccctctgaaggaagcggactgcccctgcaggacacaggagacaccccaaatac

SEQ ID NO: 46248 - DNA, 201 bp, Homo sapiens
acatgactacagctgatgctttctggaaagcaccacctcctggcaggaggccaaccagcacaaaaatagagcattaaaccaccgaagttaaggaccctcayggagtccattataccctcctccacctccactggaacaggtgctggtatccatggctgagagacccacagacggttcacatcacaggactctgtgcagaca

SEQ ID NO: 46249 - DNA, 201 bp, Homo sapiens
cagggaaggtacctgaggtcactggcttggcggtagcggcaggggtggcagaggtggaactgcagagttgcagggtccactgacccttaccctcagctggrgaataaccctccagatcaactgcaagaacaaaccagcaatcctgagaggagccgcagaccctctgaaggaagcggactgcccctgcaggacacaggagac

SEQ ID NO: 46250 - DNA, 201 bp, Homo sapiens
ccaccaggaaacagactcgaggctgttgggggaggcacggtgggagtgaggccgacccttcggtttctgtgggagctgggtgaggcctgtgattgccagcyttccccaacttccctgacaacctgtatgactcaacagaggcagccataatcctcctaggtacacaattccagtgacctaggaatcccacccccatccccc

SEQ ID NO: 46251 - DNA, 201 bp, Homo sapiens
cacctgggctggcaaggaaggggcacccgtctgggtgggtggggcagggaaggtacctgaggtcactggcttggcggtagcggcaggggtggcagaggtgraactgcagagttgcagggtccactgacccttaccctcagctggagaataaccctccagatcaactgcaagaacaaaccagcaatcctgagaggagccgca

SEQ ID NO: 46252 - DNA, 201 bp, Homo sapiens
ggccagaggagaagggggtaaaactccatagggagaaggaattctctagctgaactttataacaatttgaaaggggcaagaagcctcctgaccagaacctrggggagagcatgaatctggtgtgcagacttcacatgcagggggaagaactgaagcccttttcttccacagctggaagggaaaaagccttgggcaagtttt

SEQ ID NO: 46253 - DNA, 201 bp, Homo sapiens
gaggttgcagtgagctgagattgcaccactgcactccagcctgggcaacagagagagactccatctaaaaaaaaaaattaattaattaattaattaattawattgaaaggacaagaaagggaggattaattgcacaatttgggttttgcatccttaaaatgaaatattaattttaccaagcagttagttttttaagagtag

SEQ ID NO: 46254 - DNA, 201 bp, Homo sapiens
gaatatagaagaacgatccaggagatccaacatccaaataagaggatttatagacccagaatcagtgaggagaaatcctcactgcatgggaaagtacaggygcacaaagctagatgcaagttgtttagtcaattttaataaggttattctgcagtcaataacagccctagaatctcggtggcttacaacagtgaaagttgg

SEQ ID NO: 46255 - DNA, 201 bp, Homo sapiens
aagatatgtaaatagccaataaacatatgaaaagatgttcaacatcattagtcattaggaaaatgcaaatcaaaataataatgagttaccatttcaaacayactaagatagctttaatttaaaagagtacaaataggccaggagtggtggctcatgcctgtaatcccagcactttgggaggccgaggcgggcaatcacctg

SEQ ID NO: 46256 - DNA, 201 bp, Homo sapiens
tccctttggaactaagcttttgtttagcttttaatatttaattcaaacatcaactttccttcctggattgcacccttctcccaccaccggatccctaggtkcggggggtgtctaccccaacacactcccattgtttgtctgtgggaagagctccccaagggcaatggctgccccgacttatttgtctgtatcgccagctcc

SEQ ID NO: 46257 - DNA, 201 bp, Homo sapiens
caagccagtttcattgtttgggactacagtgtcttagttccctttggaactaagcttttgtttagcttttaatatttaattcaaacatcaactttccttcytggattgcacccttctcccaccaccggatccctaggttcggggggtgtctaccccaacacactcccattgtttgtctgtgggaagagctccccaagggca

SEQ ID NO: 46258 - DNA, 201 bp, Homo sapiens
tcatgtgtagaggtcaaggaaactgcttaatgtcctacaatgcacaagacagccccaacaacagttatctggccaaaaatataaagcgtgccaaagtcaakaaatcatgccgtaacatatctttcaaaaatgtaaataagccgggcattggtggcttgctcctgtaatctcagctactcaggaggctgaggcaggagaatc

SEQ ID NO: 46259 - DNA, 201 bp, Homo sapiens
tgggggaagagctgggttatcaaggccatccaggcacttatcctgcaatgcccaggaaagtcaccccagaggaggttacatttgagttggcctcaaagcayggctagaatttctagtccttatctggaggaaatagagtgaggaaaaacatacagctgagtatgccaaaaacacaagttgtccagtgaatgtgtgtaaact

SEQ ID NO: 46260 - DNA, 201 bp, Homo sapiens
caaccaaggtaattttgctccccaggagatactgttagttgacacaactgagaagggaagtgatacggtcatctcatgtgtagaggtcaaggaaactgctwaatgtcctacaatgcacaagacagccccaacaacagttatctggccaaaaatataaagcgtgccaaagtcaagaaatcatgccgtaacatatctttcaaa

SEQ ID NO: 46261 - DNA, 201 bp, Homo sapiens
atgttaaatgaaattagaattctatattcagtagaccagttgttcccaaccaaggtaattttgctccccaggagatactgttagttgacacaactgagaarggaagtgatacggtcatctcatgtgtagaggtcaaggaaactgcttaatgtcctacaatgcacaagacagccccaacaacagttatctggccaaaaatat

SEQ ID NO: 46262 - DNA, 201 bp, Homo sapiens
ggaagtgtatccatatccttgactcaagccagtttcattgtttgggactacagtgtcttagttccctttggaactaagcttttgtttagcttttaatattyaattcaaacatcaactttccttcctggattgcacccttctcccaccaccggatccctaggttcggggggtgtctaccccaacacactcccattgtttgtc

SEQ ID NO: 46263 - DNA, 201 bp, Homo sapiens
tggacagcttttccttatctcagaatgttgtttccagcacattctagcattattctgagaactacaagtgaaaaatgggggaagagctgggttatcaaggycatccaggcacttatcctgcaatgcccaggaaagtcaccccagaggaggttacatttgagttggcctcaaagcacggctagaatttctagtccttatctg

SEQ ID NO: 46264 - DNA, 201 bp, Homo sapiens
gtcaggagtttgagaccagcctgaccaacatggtgaaatcccatctctaataaaaatacaaaattagcagggcatggaagccggcacctgtaatcccagcyactggggaggctgaggcaggaggattgcttgaacccaggaggcagaggttgcagtgagccaagactgtgccattgcactccagcctgggcaacaagagtg

SEQ ID NO: 46265 - DNA, 201 bp, Homo sapiens
cagagtgtctatacttcagaatcttgtcaggaaattctccctgcatgttttaaagtgtgatgtcaagatacaatcatcattgacaattttctgaagaatakgaagtgtatccatatccttgactcaagccagtttcattgtttgggactacagtgtcttagttccctttggaactaagcttttgtttagcttttaatattt

SEQ ID NO: 46266 - DNA, 201 bp, Homo sapiens
cattggaggacatcttgtcctaagaggaacagaaacagaatctggcatgttctggacagcttttccttatctcagaatgttgtttccagcacattctagcrttattctgagaactacaagtgaaaaatgggggaagagctgggttatcaaggccatccaggcacttatcctgcaatgcccaggaaagtcaccccagaggag

SEQ ID NO: 46267 - DNA, 201 bp, Homo sapiens
gtagaccaagagcctttattaataacctagaaagattaatctggtattagttctgattaggtttagggttagggttaatatggtggggtctattatcatgsgtgtgaatgcactcactagagcacaggcatacgcatgttcatctgaacaaacacacacacatgcacgcgtacgcacgtgcacacacacacactatattcc

SEQ ID NO: 46268 - DNA, 201 bp, Homo sapiens
ctccactctgggttttataccctggggggaaactgggatcactggaccacagcattggaggacatcttgtcctaagaggaacagaaacagaatctggcatrttctggacagcttttccttatctcagaatgttgtttccagcacattctagcattattctgagaactacaagtgaaaaatgggggaagagctgggttatca

SEQ ID NO: 46269 - DNA, 201 bp, Homo sapiens
gactgactttcagatgtatgaaaaaattggaccaagttcttgaaaaactggttgtcaaatcctaattctgtagatgttccaagaattcttgagctttaaamaatgatccctgtcatgaaatgttttattttctagaaaattcttatgcctgacaaatacatcatattcatagagtacttttatattagatttcaggagctt

SEQ ID NO: 46270 - DNA, 201 bp, Homo sapiens
tctcactttactccttgctattttgagttcttacagttgactgactttcagatgtatgaaaaaattggaccaagttcttgaaaaactggttgtcaaatccyaattctgtagatgttccaagaattcttgagctttaaaaaatgatccctgtcatgaaatgttttattttctagaaaattcttatgcctgacaaatacatca

SEQ ID NO: 46271 - DNA, 201 bp, Homo sapiens
gtatcctcatgtggtggaagggataagggagggacctctctggggtgtcttctataagggcactaatcccatcccgagggctccatccttgtgacctaatyacctcccaaaggccccacatcccaataccatcaccttgggggttagcattttaacatacgagtttcggagggacacaaatattcagaccatagcacactc

SEQ ID NO: 46272 - DNA, 201 bp, Homo sapiens
tcccatcccgagggctccatccttgtgacctaattacctcccaaaggccccacatcccaataccatcaccttgggggttagcattttaacatacgagtttyggagggacacaaatattcagaccatagcacactcgtgcctggggaaggtcatatcgagtgaccaatggatggtggagcataagggcttggccagctcagc

SEQ ID NO: 46273 - DNA, 201 bp, Homo sapiens
acctcccaaaggccccacatcccaataccatcaccttgggggttagcattttaacatacgagtttcggagggacacaaatattcagaccatagcacactcrtgcctggggaaggtcatatcgagtgaccaatggatggtggagcataagggcttggccagctcagccatgcttggcatgtttctaaaagtccacctaactc

SEQ ID NO: 46274 - DNA, 201 bp, Homo sapiens
cccacatcccaataccatcaccttgggggttagcattttaacatacgagtttcggagggacacaaatattcagaccatagcacactcgtgcctggggaagstcatatcgagtgaccaatggatggtggagcataagggcttggccagctcagccatgcttggcatgtttctaaaagtccacctaactccagagctcttggt

SEQ ID NO: 46275 - DNA, 201 bp, Homo sapiens
acagaacccagtagcagatggtgcaatgaggaaaacaaaaggagtgtcatgtactggaggcttgggtccccctcagatccatatgttgaagctgtaacccycaatgtgatggcatttgaggtggagtcttcaggaaataattaggtttacatgaggtcatgagggtggggcccccgtggtgggattagtgcccttacaaga

SEQ ID NO: 46276 - DNA, 201 bp, Homo sapiens
gaccccgcctcactcgcatgcaacatgctgttttactgacctctcagccttgtttatttatctgtttagagtgtgtctctccacttcaatagaatggaatgtagactctaggagaatggggagcctttgggctttattcgaggatatattctcaaattttagaacagtgcctggcacatagcaggcagtcagtaagtattt

SEQ ID NO: 46277 - DNA, 201 bp, Homo sapiens
agaccccgcctcactcgcatgcaacatgctgttttactgacctctcagccttgtttatttatctgtttagagtgtgtctctccacttcaatagaatggaatgtagactctaggagaatggggagcctttgggctttattcgaggatatattctcaaattttagaacagtgcctggcacatagcaggcagtcagtaagtatt

SEQ ID NO: 46278 - DNA, 201 bp, Homo sapiens
tagaccccgcctcactcgcatgcaacatgctgttttactgacctctcagccttgtttatttatctgtttagagtgtgtctctccacttcaatagaatggaatgtagactctaggagaatggggagcctttgggctttattcgaggatatattctcaaattttagaacagtgcctggcacatagcaggcagtcagtaagtat

SEQ ID NO: 46279 - DNA, 201 bp, Homo sapiens
aaaatacttttgtgaccaacatcagccaatattctatagcgctgatcacatcattgagttacctagggtccatgttgcaaccactctgtcttagagcagtyatcaggaagttgaactttctaaaattagacttcttttatatttatttatttttttttttttgagacagtctcattctgtcactcaggctggagtgcagtg

SEQ ID NO: 46280 - DNA, 201 bp, Homo sapiens
ttagaccccgcctcactcgcatgcaacatgctgttttactgacctctcagccttgtttatttatctgtttagagtgtgtctctccacttcaatagaatggaatgtagactctaggagaatggggagcctttgggctttattcgaggatatattctcaaattttagaacagtgcctggcacatagcaggcagtcagtaagta

SEQ ID NO: 46281 - DNA, 201 bp, Homo sapiens
tttagaccccgcctcactcgcatgcaacatgctgttttactgacctctcagccttgtttatttatctgtttagagtgtgtctctccacttcaatagaatggaatgtagactctaggagaatggggagcctttgggctttattcgaggatatattctcaaattttagaacagtgcctggcacatagcaggcagtcagtaagt

SEQ ID NO: 46282 - DNA, 201 bp, Homo sapiens
acagctgatcatgtcaaaccaacaggggtttcctcaaagttttctagaattttcagataaagttcagactcttcttgtcaacccacaaggccttatgaaamaacgctcatctagttcctcagtcccattgctcatgaatcctccatagccaccagctctttgtgcttcagcctggaacccaccagactacccggctcctcc

SEQ ID NO: 46283 - DNA, 201 bp, Homo sapiens
cctgtcatgaaatgttttattttctagaaaattcttatgcctgacaaatacatcatattcatagagtacttttatattagatttcaggagctttacatttktttggctgacagagcgtttccaacaccctgaacattttcttagtacctttgttttatacttggaggactgaggcctgaataacttgtctcacatagcaag

SEQ ID NO: 46284 - DNA, 201 bp, Homo sapiens
atttctctcattatctctcttcctcatctggcctgagcccagctctgggtgtgagctgtggagagaggttttctgccaggattgggcaagggcattctccyctaatacagggccttcagagactgctctaccgaaggaagtgtctgagtcaatgtgaaactggaaagaagagagatatggtttggctgtgaccccactcaa

SEQ ID NO: 46285 - DNA, 201 bp, Homo sapiens
aggattgcttgagcccagcagttcaaggctatagtgtgctatgatcaagtctgtgaatagtcactgtactccaggttggtcaacatagcaagaccccatckaataatgattgcaagttgcagccaagtctcctgcaagttcaccttccatagtgtatctcaaatctgtctcctctttaccatcttcagcgccatctccatg

SEQ ID NO: 46286 - DNA, 201 bp, Homo sapiens
ttcacaaagcaatgtgctctcaaaacacagccattcatttgaagttgtcttttagtctgaatccaaatcctccagtcaatacaaaccataatatgctgctyggtctctgtggatccattctgcctcaagctatgagcttcaaaattctcaaagagttggacttcaatgctgtttcttatattttataatactatttaatct

SEQ ID NO: 46287 - DNA, 201 bp, Homo sapiens
caacatgatgaaaccccgtcactacaaaaaaatacaaaaattagccagaggttgtggcatgttcctgtggtcccagctactcaggaggttgaggcagaagmatcgcttgaactcaggaggtggaggttgcagtgagctgagattgcaccactgcactccagcctgggcaacagagagagactccatctaaaaaaaaaaatt

SEQ ID NO: 46288 - DNA, 201 bp, Homo sapiens
tattccccaaacattgtaaagaaaaacagaaagttttgattgcatgagcaactctttctttgcactttagattttcatacgcttttcatatctgattttcrtgggtgatttccatggatgattttcatgtctgaatctcatttacttcttatgttgttaagctttcctctccctttcctctttacctagacccagagatgc

SEQ ID NO: 46289 - DNA, 201 bp, Homo sapiens
gtttcaagggagagctatgtcctgataacccaagaaataacaatcttaaaccctaaattatttgggaaaaaaaagcgaaactggaatattaactgtaaccyacttatttgtataaaaatcctggatatgaccagagatttttgcacacttcatgtagacaagtagggaaagaaaagagattatcagtgtcctacaaaagac

SEQ ID NO: 46290 - DNA, 201 bp, Homo sapiens
gggccgtatccaacatgtgggaagtgccatttcagggaaaagagcccaaatattccggaacatctggggaagataaaaggaagttgttcttgggataaatytggtgagaacctactttcaagagcagagtttagggcctgtcctggctggaggagctgattttaagaacagaaagaacagtccagtattaaatgttaattt

SEQ ID NO: 46291 - DNA, 201 bp, Homo sapiens
caactcttcacatctaataagctagtttcaagggagagctatgtcctgataacccaagaaataacaatcttaaaccctaaattatttgggaaaaaaaagcraaactggaatattaactgtaacctacttatttgtataaaaatcctggatatgaccagagatttttgcacacttcatgtagacaagtagggaaagaaaaga

SEQ ID NO: 46292 - DNA, 201 bp, Homo sapiens
tcacgtgggttgtttgcttaaaatgcaaattcctgggtcccgtttttgattatcctgaatcagaatttttgagggtggagccaagggatctgcattctaayaagtttcccagtggttctggttcacaccagagttttaggaactcttgaaactggggtagggtggacaggagctggctcccagtgggcaggagcttcaggg

SEQ ID NO: 46293 - DNA, 201 bp, Homo sapiens
tggacttcaatgctgtttcttatattttataatactatttaatctgcctgaaggtgtaggatgtaatgtcatgatactgtacaaacttctgggctactggycaaccgatacagatgagaaatattctattactatgaagctggagttccttcctactatttcatttgtatacatttgtattcatagcaattatttacttaa

SEQ ID NO: 46294 - DNA, 201 bp, Homo sapiens
gagcacattatttaaatttagatttaatgatactgacttccattaatgcttttatttgttgtcttaaaactcatccttgagtctacagcaaagacttgccctgtggcagcttggtgcactgttaagagttaggaactaatagcttgaacaaggactgagttagaaatttgtgtctgccacttactgactacttgtatggca

SEQ ID NO: 46295 - DNA, 201 bp, Homo sapiens
actatttaatctgcctgaaggtgtaggatgtaatgtcatgatactgtacaaacttctgggctactggccaaccgatacagatgagaaatattctattactrtgaagctggagttccttcctactatttcatttgtatacatttgtattcatagcaattatttacttaaatattttagcacatgtaattttgaaattataaa

SEQ ID NO: 46296 - DNA, 201 bp, Homo sapiens
gttcactatgttggcgaggatggtcttggtctcctgacctcatgatccacctgcctctgcctttcaatgtgctgggattacaggtgtgagccaccacgccygccctcatccaaacaatttaaaacatgaacttgtccaggcgctgtaactcatgcctgtaattccagcactttaggaggctgaggcgggtggatcaccgga

SEQ ID NO: 46297 - DNA, 201 bp, Homo sapiens
tgtgttttctatatctgcaagtaaattcaattcttaactaatacactaagctctaatgaacttgtatgatgtgcctgacactacactaaatacctgatgtrtgttgtgctctttgataccccagaacagctctcctacaggacactgaggtgcagagagattaagcaatttactcaaggtcacatggctctaccgatacct

SEQ ID NO: 46298 - DNA, 201 bp, Homo sapiens
tcacacttcttgtttggtgacagaaaaagcccagatctttaagccactgttacctgtgttttctatatctgcaagtaaattcaattcttaactaatacacyaagctctaatgaacttgtatgatgtgcctgacactacactaaatacctgatgtatgttgtgctctttgataccccagaacagctctcctacaggacactg

SEQ ID NO: 46299 - DNA, 201 bp, Homo sapiens
ttgcctaataatagggctttaagggtttttaaaaattggtttcctttggggatcatttaaatttcccatttccttgtaaatatttttggtaaaaacattatcctcttggatttcagaggaagttaaaatagaaaaagcttgaaagcattcacaaagcaatgtgctctcaaaacacagccattcatttgaagttgtctttta

SEQ ID NO: 46300 - DNA, 201 bp, Homo sapiens
tttgcctaataatagggctttaagggtttttaaaaattggtttcctttggggatcatttaaatttcccatttccttgtaaatatttttggtaaaaacattatcctcttggatttcagaggaagttaaaatagaaaaagcttgaaagcattcacaaagcaatgtgctctcaaaacacagccattcatttgaagttgtctttt

SEQ ID NO: 46301 - DNA, 201 bp, Homo sapiens
gtttgcctaataatagggctttaagggtttttaaaaattggtttcctttggggatcatttaaatttcccatttccttgtaaatatttttggtaaaaacattatcctcttggatttcagaggaagttaaaatagaaaaagcttgaaagcattcacaaagcaatgtgctctcaaaacacagccattcatttgaagttgtcttt

SEQ ID NO: 46302 - DNA, 201 bp, Homo sapiens
ggaaagagaaaaatttaagaatgaaaaaacagaaagagatggaaagaaggaaagaagggaggaagggagagaaagaaagagaaaggaagagagggagggcrggagggaggaggacagggaaggaaagagaaagaatgaaaaagggagagagaaagaaaaaagggagagagggagggaggaaggaaggaaggaaggaaggaa

SEQ ID NO: 46303 - DNA, 201 bp, Homo sapiens
gaaaggagagagggaaggaagttaggaaagagaaaaatttaagaatgaaaaaacagaaagagatggaaagaaggaaagaagggaggaagggagagaaagaragagaaaggaagagagggagggcgggagggaggaggacagggaaggaaagagaaagaatgaaaaagggagagagaaagaaaaaagggagagagggaggga

SEQ ID NO: 46304 - DNA, 201 bp, Homo sapiens
aattctagaggctgggaaggccaaagtcaaggcaccagcaaatttgatgcctggtgagggttggcttcctaactgatagacaatgtcttcttactgtatcctcatgtggtggaagggataagggagggacctctctggggtgtcttctataagggcactaatcccatcccgagggctccatccttgtgacctaattacctc

SEQ ID NO: 46305 - DNA, 201 bp, Homo sapiens
aattattgttgctttgctatgtcacccagtcacttgtttctgttcactggagcagatccaaaacaattctttaatgaattttcgcactgcctgcaggtacwgctgccactcacctctgaattaaggaatttcaggggtgatctcattatgctcaattttcctcgatgtcagacctgacccccagccaatttcctgttaaag

SEQ ID NO: 46306 - DNA, 201 bp, Homo sapiens
tggcttcaggaatatgtcctgtctaacttttaaaatggactgttcgttgattatcaaacatatgctcaatctctctttttttttttttttttttttgaggkggagttttgctcttgttgtccagctggagtgcaatggcgcgatctcagctcactgcaacctctgcctcctgggttcaagtgattctcctgccttaccctc

SEQ ID NO: 46307 - DNA, 201 bp, Homo sapiens
gttgcaaccactctgtcttagagcagtcatcaggaagttgaactttctaaaattagacttcttttatatttatttatttttttttttttgagacagtctcrttctgtcactcaggctggagtgcagtggtgcaatcttggctcactgcaacctccgtttcccaggttcaagcaatttttgtgtctcaacctcctgaatagc

SEQ ID NO: 46308 - DNA, 201 bp, Homo sapiens
ggtagttgaaaagaggagagaagaatgcagacacagcctgagaaagggcaaagggccgtatccaacatgtgggaagtgccatttcagggaaaagagcccaratattccggaacatctggggaagataaaaggaagttgttcttgggataaatttggtgagaacctactttcaagagcagagtttagggcctgtcctggctg

SEQ ID NO: 46309 - DNA, 201 bp, Homo sapiens
atcgcagcctgagcacagtaagacaaggggtagtgctttttaatcaaatcaattttgaaaatgccccatacagtactatcttcctatcttaaaggaccaaygatgcctattgaaatcaaagactctgaaaagtcctgcagtaaaggaagctatttaaatttgtttaaacaattgcttctcaaactttttgactatggaata

SEQ ID NO: 46310 - DNA, 201 bp, Homo sapiens
attgagttacctagggtccatgttgcaaccactctgtcttagagcagtcatcaggaagttgaactttctaaaattagacttcttttatatttatttatttwtttttttttgagacagtctcattctgtcactcaggctggagtgcagtggtgcaatcttggctcactgcaacctccgtttcccaggttcaagcaatttttg

SEQ ID NO: 46311 - DNA, 201 bp, Homo sapiens
ctctcaggaagaacctgatccataactctgaatgctcctgggatctgttaagcaagaatctgtgttttaattttattacatctagaaattaatagactgtraaaatttccccttggtttgctttttaaaatcatcttgtattgtttctctttttgttgtgtttttattttaaagaaaaatgttcaagtttaccttctcaat

SEQ ID NO: 46312 - DNA, 201 bp, Homo sapiens
atcttttttttttttctttttttcttggagacagagtcttgctcaatcacccaggctggagtgcagtggtataatctcagctcactgcaacctccgcctcyggggttcaatcaattctcctgcctcagcctcctgagtagctgggattacaggcatgctccatcacgcccagctcatttttgtatttttagtagagatggg

SEQ ID NO: 46313 - DNA, 201 bp, Homo sapiens
gatgcaatggcggcggcagcccttttgtgaccagacatgagagaaaggcccagagagtcacagagaccttgcatccatctgcttgtttaggtctctggtcsagctcagggtcaccaaccttcacacttcttgtttggtgacagaaaaagcccagatctttaagccactgttacctgtgttttctatatctgcaagtaaatt

SEQ ID NO: 46314 - DNA, 201 bp, Homo sapiens
aatgtgtgagtaaacttaaacggatgataataacattaagcaacagtaacaattccttatgtggtttaaaatacatatagaattaaaattacaagaattgyatataggtcaagctgagagtaaatgaaattaaagtgttctgagattttattttggttcagagtgagagtgataataccatatagcattagaatcaataag

SEQ ID NO: 46315 - DNA, 201 bp, Homo sapiens
gaggcaggagaatcacttaaggccatgagtctgaaaacagtctgggccatgtagtgagaccctatctctaaaaaagaagaacgcatataaaatgaaaaaawatttgcagacaaatgaacgttgagataattggctatcagtagatctacatcaaaggaaataaacggcaaatatttacctgatcttttcaggtaaaagaaa

SEQ ID NO: 46316 - DNA, 201 bp, Homo sapiens
ggaggctgaggcaggagaatcacttaaggccatgagtctgaaaacagtctgggccatgtagtgagaccctatctctaaaaaagaagaacgcatataaaatgaaaaaatatttgcagacaaatgaacgttgagataattggctatcagtagatctacatcaaaggaaataaacggcaaatatttacctgatcttttcaggta

SEQ ID NO: 46317 - DNA, 201 bp, Homo sapiens
tttttttctttttttcttggagacagagtcttgctcaatcacccaggctggagtgcagtggtataatctcagctcactgcaacctccgcctctggggttcratcaattctcctgcctcagcctcctgagtagctgggattacaggcatgctccatcacgcccagctcatttttgtatttttagtagagatggggtttcacc

SEQ ID NO: 46318 - DNA, 201 bp, Homo sapiens
cacaagacagccccaacaacagttatctggccaaaaatataaagcgtgccaaagtcaagaaatcatgccgtaacatatctttcaaaaatgtaaataagccrggcattggtggcttgctcctgtaatctcagctactcaggaggctgaggcaggagaatcacttaaggccatgagtctgaaaacagtctgggccatgtagtg

SEQ ID NO: 46319 - DNA, 201 bp, Homo sapiens
ttttttctttttttcttggagacagagtcttgctcaatcacccaggctggagtgcagtggtataatctcagctcactgcaacctccgcctctggggttcawtcaattctcctgcctcagcctcctgagtagctgggattacaggcatgctccatcacgcccagctcatttttgtatttttagtagagatggggtttcacca

SEQ ID NO: 46320 - DNA, 201 bp, Homo sapiens
ggcatgctccatcacgcccagctcatttttgtatttttagtagagatggggtttcaccatgttggccaggctggtctcaaactgctgacctcaagtgatcyacctgcctgtcagtttggagccaagtaggcagaaggtcagcagaggactagaaagaaactctctgttcccaaaccagtcaagcgccttcctctgggctcg

SEQ ID NO: 46321 - DNA, 201 bp, Homo sapiens
ccccaaacattgtaaagaaaaacagaaagttttgattgcatgagcaactctttctttgcactttagattttcatacgcttttcatatctgattttcatggrtgatttccatggatgattttcatgtctgaatctcatttacttcttatgttgttaagctttcctctccctttcctctttacctagacccagagatgctccc

SEQ ID NO: 46322 - DNA, 201 bp, Homo sapiens
aggttagattcatttttccatatggctctctggctactttagcaccatttgtttaaattcctgttggactgttttggtgcctttgtggaaaatcaaacacmtgtgtaagcgcagatctattcctttatctttttaaaaatgtaaatactagccgggagcggtggcttatgcctgtaatcccagcactttgggaggctgaga

SEQ ID NO: 46323 - DNA, 201 bp, Homo sapiens
ctttacctagacccagagatgctcccagtatgttagagcacattatttaaatttagatttaatgatactgacttccattaatgcttttatttgttgtcttraaactcatccttgagtctacagcaaagacttgccctgtggcagcttggtgcactgttaagagttaggaactaatagcttgaacaaggactgagttagaaa

SEQ ID NO: 46324 - DNA, 201 bp, Homo sapiens
tatagccatcattgtgatgctacagaataccaaaatcagagataaaaatgttaaaagccagtcaaagcagagtgagactctgtctcaaaaaaaaaaaaaaagccagtcaaagtacctaagaccaaacgttggacatatagcttacttttcaatggtaatagtgaaagccagaggacaatgaaattatatcttaaatatgtt

SEQ ID NO: 46325 - DNA, 201 bp, Homo sapiens
caagttcctcatggcataaagtgggaagacaaaggggaaggatggcagctgggggttagctcttgctgtcccattaccttctggcttgggctatagagccyaggaattctagcctgccatgtagttatgtatatatatttgacagtttattcacttgatagataacttctaagtatttcaacatagcttatgggccttcat

SEQ ID NO: 46326 - DNA, 201 bp, Homo sapiens
ccaggaaatttctattcccatgaatgttggagaaatgtcagcttagagggttctgccccggccatcctctgctgcccttcccctcagtgcaggcaaggtcygcactgagtcacagatttaacattatagttagtcataaatgttttaaaattatgagtctgcaaggtcaagggcatgcgtcctcctggaaactcttcccca

SEQ ID NO: 46327 - DNA, 201 bp, Homo sapiens
ccctagacctactgattcagatcccaggaaatttctattcccatgaatgttggagaaatgtcagcttagagggttctgccccggccatcctctgctgcccytcccctcagtgcaggcaaggtctgcactgagtcacagatttaacattatagttagtcataaatgttttaaaattatgagtctgcaaggtcaagggcatgc

SEQ ID NO: 46328 - DNA, 201 bp, Homo sapiens
tattatcttcttggtatatatccaaggtaattgaaaatgtatgttcacacaaaaacttgtatatgaatgttcttagcagtattattcacaatagcccaaasgtggaaataacctaaatttctataaactgaagaatggataaacaacatgtggtatttccatacaatggaatatcatttaaccgaaaagggaatgaaatta

SEQ ID NO: 46329 - DNA, 201 bp, Homo sapiens
aagagacaagggctgggtcactctccagaacatgagcacacagtgagatggcagccatctgcaggccaggaggagtgccctctccaggaactcaatctgcyggcccttgaccgtgaacttcccagcctccagagccatgagaagtaaatgtctgctgtttaagccacccagtctatggtattttgtaatcgcagcctgagc

SEQ ID NO: 46330 - DNA, 201 bp, Homo sapiens
tattcacaatagcccaaaggtggaaataacctaaatttctataaactgaagaatggataaacaacatgtggtatttccatacaatggaatatcatttaacmgaaaagggaatgaaattacatgctacaacatgaatgacttttgaaagcattatattagttgaaagaacccggacgcaaagaccacatattacacaattcc

SEQ ID NO: 46331 - DNA, 201 bp, Homo sapiens
ggaggttgcagtgagctgagattgcaccactgcactccagcctgggcaacagagagagactccatctaaaaaaaaaaattaattaattaattaattaattatattgaaaggacaagaaagggaggattaattgcacaatttgggttttgcatccttaaaatgaaatattaattttaccaagcagttagttttttaagagta

SEQ ID NO: 46332 - DNA, 201 bp, Homo sapiens
gtgatggcatttgaggtggagtcttcaggaaataattaggtttacatgaggtcatgagggtggggcccccgtggtgggattagtgcccttacaagaagagraagagacaagggctgggtcactctccagaacatgagcacacagtgagatggcagccatctgcaggccaggaggagtgccctctccaggaactcaatctgc

SEQ ID NO: 46333 - DNA, 201 bp, Homo sapiens
atctcaaaataattaaatagaaaaacagagttaatggctgcttttcaaaacgtgtgaaaggcctcattcatagactcaagaagcccaacaaattccaaacyaaataaagaaaaattcacaactatagccatcattgtgatgctacagaataccaaaatcagagataaaaatgttaaaagccagtcaaagcagagtgagact

SEQ ID NO: 46334 - DNA, 201 bp, Homo sapiens
gagcctgcactggagtttgtgtgtccctatgtgcattccacagaacccagtagcagatggtgcaatgaggaaaacaaaaggagtgtcatgtactggaggcytgggtccccctcagatccatatgttgaagctgtaacccccaatgtgatggcatttgaggtggagtcttcaggaaataattaggtttacatgaggtcatga

SEQ ID NO: 46335 - DNA, 201 bp, Homo sapiens
aattctttccaattttctgttaaaatgaacagacctcagatttgtatgttcctgcctaaagcagcaagcatggatgcaatggcggcggcagcccttttgtkaccagacatgagagaaaggcccagagagtcacagagaccttgcatccatctgcttgtttaggtctctggtccagctcagggtcaccaaccttcacacttc

SEQ ID NO: 46336 - DNA, 201 bp, Homo sapiens
gctaacacttccataccaattctttccaattttctgttaaaatgaacagacctcagatttgtatgttcctgcctaaagcagcaagcatggatgcaatggcrgcggcagcccttttgtgaccagacatgagagaaaggcccagagagtcacagagaccttgcatccatctgcttgtttaggtctctggtccagctcagggtc

SEQ ID NO: 46337 - DNA, 201 bp, Homo sapiens
gtagtgagaccctatctctaaaaaagaagaacgcatataaaatgaaaaaatatttgcagacaaatgaacgttgagataattggctatcagtagatctacawcaaaggaaataaacggcaaatatttacctgatcttttcaggtaaaagaaaataatcccacaagtaaaattgaagaggcaggaaggacaatgaaaatagca

SEQ ID NO: 46338 - DNA, 201 bp, Homo sapiens
aaaaaataaaagagtacaaaataacaaatgttggtgagagcttggagaaattagaaccctcatacattgctggtgaaaatgtaaaatgatgcagccgctgyggaaaagagtctggcaggttctcaaaaagttaaacctagaattactatatgactcagcaattattatcttcttggtatatatccaaggtaattgaaaatg

SEQ ID NO: 46339 - DNA, 201 bp, Homo sapiens
aacagtgtgattaactaaaaattttacactaaatgctaagacagctctcctttccttctcgccatgtttatttatttatttatttatttatttatttattwatttatttgagatggaatttcactcttattgcccaggctggagtgcagtgacgcaacattggttcactgcaacctccacctcccggttcaagtgattctc

SEQ ID NO: 46340 - DNA, 201 bp, Homo sapiens
acactcctgttagaatgaatggctatagctgacacactctgcctttggatgcatagaatatttcaccataagatgatatacactcgccacagagttttttwattttgtttatttatttatttttgttgttgttgttttcgagactgagccttgctctgttgcttaggctggagtgcaatggtgcaatctcagctcactgca

SEQ ID NO: 46341 - DNA, 201 bp, Homo sapiens
tattgagctatacactcaaaaatggtcaatgtggtaaagtttatgttgtgcatattttaattttatcacaatttaaaaattataaaggagaggaataggcygggcacgatggctcatgcttgtaatcccagcattttcagaggctgagatgggtggatcacttaaggccaggagtttgagaccagcctggcaaacatggtg

SEQ ID NO: 46342 - DNA, 201 bp, Homo sapiens
gcagtggcagaggcagaaatgagttctttaatgggtacagagtttcagttttgcaagataaaaaagttctggaaattgcttgtgcaacaatgtgaacgtasttaacactattgagctatacactcaaaaatggtcaatgtggtaaagtttatgttgtgcatattttaattttatcacaatttaaaaattataaaggagagg

SEQ ID NO: 46343 - DNA, 201 bp, Homo sapiens
actatgttcaagctctaaatattagtgactgtggtgtcttaatgacctacttaacttctctctttaacttggtgttgccaacttattgaataaactttttktcttgccaactacccatttaataaaatggctcattaatgcagtcagatctccttcagtggctttgccgtggtgtctgtacttttttctgctgccatgagc

SEQ ID NO: 46344 - DNA, 201 bp, Homo sapiens
atgacttataaaactcttttaaacacaactccaagcattttcatggacttcttaaaacgtattcctggcatggacggattaatggataaacaagatgtggyctatccatacgatggaatgttattcagtcttgaaaagcaaggaagctctgactcatgctacaacatggatgaaaattgaagacattatgccaagtgaaaa

SEQ ID NO: 46345 - DNA, 201 bp, Homo sapiens
gatcgagaccatcctggctaacatggtgaaaccccgtctttactaaaaatacaaaaaataagccgggtgtggtggcacacgcctgtagtcccagctactcrggagactgaggcaggagaatcgcttgaacccgggaggctgagtgagccaagattgtgccgctgcactcagcctgggtgacagagtgagactccatctcaa

SEQ ID NO: 46346 - DNA, 201 bp, Homo sapiens
acacctacattctaccataaacattttatttgctttgctctctcgctctgtctctcttcttccccctctccctccctctatcaatctttttttttttttttggaatatttaaaaataaattgcaggcctcagtacaatttctcctaaatccttcagcaagcatatcactagctagatattaatatttagtttttcttttga

SEQ ID NO: 46347 - DNA, 201 bp, Homo sapiens
tttagatttaatgatactgacttccattaatgcttttatttgttgtcttaaaactcatccttgagtctacagcaaagacttgccctgtggcagcttggtgyactgttaagagttaggaactaatagcttgaacaaggactgagttagaaatttgtgtctgccacttactgactacttgtatggcattgtgaaaatttcttc

SEQ ID NO: 46348 - DNA, 201 bp, Homo sapiens
cattaacattctcctttatgaaatttgggatttgatctctttgccctaatgaagatagacacacagggtcctttcgatgagtatactcaggcagggaaggrcgaagagtggttctaagtccttcttggcagcctttcctgggcttgccaccccagatggatttgcctgctcttgagtccagtaattcaatagcctgtttcc

SEQ ID NO: 46349 - DNA, 201 bp, Homo sapiens
ggaactaatagcttgaacaaggactgagttagaaatttgtgtctgccacttactgactacttgtatggcattgtgaaaatttcttcacctctctggccaakgtttctacatctgtaaaatagaaataatacctcccattcctacctccagggctattatgaagatctaggttgatcaactgctgtataacttctagctaac

SEQ ID NO: 46350 - DNA, 201 bp, Homo sapiens
tctgtgagatggatttaaataactcatggtccactgtggaaactttttgaagctgctccccctccccatttcccccctgtcaaagtgattaggtgaatcargaggaaacaaataaaggtgcttgaaaaagtgaacctaatcacacactttctggttggtgtttgtgggcactaaaaagcattatatgcatgtggtttgagg

SEQ ID NO: 46351 - DNA, 201 bp, Homo sapiens
cgcagaatcttggtccctgccctagacctactgattcagatcccaggaaatttctattcccatgaatgttggagaaatgtcagcttagagggttctgcccyggccatcctctgctgcccttcccctcagtgcaggcaaggtctgcactgagtcacagatttaacattatagttagtcataaatgttttaaaattatgagtc

SEQ ID NO: 46352 - DNA, 201 bp, Homo sapiens
tttgcctgttacataaagggaccacttaagcccctgaaattgcaggggacatttgtgttgaagttcactattctaggattatttggtgaggtaggtatggwtgtgaaactgcaatgcacattcaaagatgacactaccacgagtccaaatctatctgcacaaagccgggaggatgggcaggcctgcctccctctttgtgtg

SEQ ID NO: 46353 - DNA, 201 bp, Homo sapiens
ttagagtctggtttctggggatacaacctgtgatgcttaaaaaattaagaggccgggcacagtgggtcatgcctataatcctagcactttgggaggccaargcaggaggattgcttgagctcagtagttgaagaccagcctgggcaacatagtgagaccatgtctctacaaaaaattttaataaaaaagaaagaaaaaaaa

SEQ ID NO: 46354 - DNA, 201 bp, Homo sapiens
tttcccaagatgtcccttcacttctcttctcttctttgattttttctttccttccagaattcccctttctagtattcagtggcctgttttcttttgagagraaaatgtttggcaacttactctttggctgcaaaagtgctgaacaggttttaaacacttggattttcccagctggccctaatcctttgcctgttacataaa

SEQ ID NO: 46355 - DNA, 201 bp, Homo sapiens
ttaacaattcctttcaagccctgttttctatgtaacagggtacattattttgaaaaaaatgtgtttattcactttaattagttagaaatcttactcctaamtagaagtatcccagaagatctgatgaaacacctgccaatcaaaggaaaagaaagcaccactaacttactgattgaagaaataaatggatcaacagagcaa

SEQ ID NO: 46356 - DNA, 201 bp, Homo sapiens
ataccaaaatcagagataaaaatgttaaaagccagtcaaagcagagtgagactctgtctcaaaaaaaaaaaaaaagccagtcaaagtacctaagaccaaaygttggacatatagcttacttttcaatggtaatagtgaaagccagaggacaatgaaattatatcttaaatatgttaaatgaaattagaattctatattcag

SEQ ID NO: 46357 - DNA, 201 bp, Homo sapiens
ccaaaatcagagataaaaatgttaaaagccagtcaaagcagagtgagactctgtctcaaaaaaaaaaaaaaagccagtcaaagtacctaagaccaaacgtwggacatatagcttacttttcaatggtaatagtgaaagccagaggacaatgaaattatatcttaaatatgttaaatgaaattagaattctatattcagtag

SEQ ID NO: 46358 - DNA, 201 bp, Homo sapiens
tacttggaaggccgaggcaggagaatcgcttaaacccaggaggtggaggttgcagtggctgagatcacgccactacactccagcctgggtgacagagtaakactctgtaaaaaagaaaaaaaaagaaaattaagaattaaaaaaaatttttttaaaaagaccaaaatgatctgccctcgatggtatcccttacatgccgcg

SEQ ID NO: 46359 - DNA, 201 bp, Homo sapiens
tggtggcatgaacttgtaatcccaggtacttggaaggccgaggcaggagaatcgcttaaacccaggaggtggaggttgcagtggctgagatcacgccactrcactccagcctgggtgacagagtaatactctgtaaaaaagaaaaaaaaagaaaattaagaattaaaaaaaatttttttaaaaagaccaaaatgatctgcc

SEQ ID NO: 46360 - DNA, 201 bp, Homo sapiens
ggcagcaccaaaaaaataacatattaataaggcgaatggttcttaacaattcctttcaagccctgttttctatgtaacagggtacattattttgaaaaaaatgtgtttattcactttaattagttagaaatcttactcctaaatagaagtatcccagaagatctgatgaaacacctgccaatcaaaggaaaagaaagcacc

SEQ ID NO: 46361 - DNA, 201 bp, Homo sapiens
gatcggatacccttggtataaaggaacttttttctagtgctaaatcccttcccaacgtgtcaggcttgctttgtcagtgcctgggtcagtgttggggctcygctgctgattccatttatcacccccttaggcagtttccctcccagactctcaggccttcctgggaaccttccacctccactggcagcagggctggtcagg

SEQ ID NO: 46362 - DNA, 201 bp, Homo sapiens
gaagagatagatgctccagaaacaggacatctttgctgaagacctttttactgagtgagcataatgcatcgggagagtgcacatccccctcacttaaaacwtgctgccggttgggcaaagtggctcatgcctgtagtcccagcactttgggaggctgaggcgggcggatcacttgaggtcaggtgttcaagaccagcctgg

SEQ ID NO: 46363 - DNA, 201 bp, Homo sapiens
cgaggcgtggtggcatgaacttgtaatcccaggtacttggaaggccgaggcaggagaatcgcttaaacccaggaggtggaggttgcagtggctgagatcaygccactacactccagcctgggtgacagagtaatactctgtaaaaaagaaaaaaaaagaaaattaagaattaaaaaaaatttttttaaaaagaccaaaatg

SEQ ID NO: 46364 - DNA, 201 bp, Homo sapiens
tgagcaaatttaaccctaccacaagatagagccaaccaacagttagaacagtatgcttgggtggccactgggaacctgttgagactttaagttttactccyatccctttcattcatccatacaaatgtgtccatcagaagagatagatgctccagaaacaggacatctttgctgaagacctttttactgagtgagcataat

SEQ ID NO: 46365 - DNA, 201 bp, Homo sapiens
cagtttattcacttgatagataacttctaagtatttcaacatagcttatgggccttcattggtactcttgaatgtgaatagcgtgtctattgaatatttctcaatgtgtgttctgaggaccccatgcagcagaattcacgtgggttgtttgcttaaaatgcaaattcctgggtcccgtttttgattatcctgaatcagaat

SEQ ID NO: 46366 - DNA, 201 bp, Homo sapiens
cacacccagctaattttgtatttttagtagagatggggttttgccatgttgctcaggctggtctccaactcctgatctcaggtgatccactcacttcggcytcccaaaatgctgggattacaggcgtgagctactgtgcctgatcgagtttttacatttttaaataatggaaagaacccaaaagaagaatattttgcaaca

SEQ ID NO: 46367 - DNA, 201 bp, Homo sapiens
agtttttacttttttgagtcagagtctcactctgtcgcccaggctggagtgtagtggtgcgatctttgctcattgcaacctccgcctcctgggttcaagtratcctcctgcctcagcctcccaagttactgggattacagacatgcaccaccacacccagctaattttgtatttttagtagagatggggttttgccatgtt

SEQ ID NO: 46368 - DNA, 201 bp, Homo sapiens
tcaagcatttatccttagtgttacaaacaatccaattatactcttttatttttacatgtacaattaagttacgttatgattgagtttttacttttttgagkcagagtctcactctgtcgcccaggctggagtgtagtggtgcgatctttgctcattgcaacctccgcctcctgggttcaagtgatcctcctgcctcagcct

SEQ ID NO: 46369 - DNA, 201 bp, Homo sapiens
gatacaggcatgcgatgtgaaataagcacatcatgtaacatggggtatccatcccctcaagcatttatccttagtgttacaaacaatccaattatactctkttatttttacatgtacaattaagttacgttatgattgagtttttacttttttgagtcagagtctcactctgtcgcccaggctggagtgtagtggtgcgat

SEQ ID NO: 46370 - DNA, 201 bp, Homo sapiens
tttaaaaatcttttgtaaatttttaaatttgtaattgttgtgggtacatagtaggtgtatatatttatggggtacatgggacgttttgatacaggcatgcratgtgaaataagcacatcatgtaacatggggtatccatcccctcaagcatttatccttagtgttacaaacaatccaattatactcttttatttttacatg

SEQ ID NO: 46371 - DNA, 201 bp, Homo sapiens
ttttcctcaccagaattattaaaaagcagtaccaactcttcacatctaataagctagtttcaagggagagctatgtcctgataacccaagaaataacaatmttaaaccctaaattatttgggaaaaaaaagcgaaactggaatattaactgtaacctacttatttgtataaaaatcctggatatgaccagagatttttgca

SEQ ID NO: 46372 - DNA, 201 bp, Homo sapiens
gtcatcaggaagttgaactttctaaaattagacttcttttatatttatttatttttttttttttgagacagtctcattctgtcactcaggctggagtgcartggtgcaatcttggctcactgcaacctccgtttcccaggttcaagcaatttttgtgtctcaacctcctgaatagctggaattacaggcatgcgccaccac

SEQ ID NO: 46373 - DNA, 201 bp, Homo sapiens
ttcttaatgactgcagttggtaaatccaggttttgcaaatgttctcatgtaaataattgtggatatgatctataacagaactttgtgacttagatcatcartttttctaggtttcttgaagtggacccaaaacagtttgagtaacatcttggccctgcctataaagattctctgtgaggacatgataataaaaaagaataa

SEQ ID NO: 46374 - DNA, 201 bp, Homo sapiens
gtttttctaggtttcttgaagtggacccaaaacagtttgagtaacatcttggccctgcctataaagattctctgtgaggacatgataataaaaaagaatarcgactaaacactgagtgctaactatgtgctaggcatgcttctaatcactttacacgcattcactcattctaacctcacaaccctatggcaggtaatgtaa

SEQ ID NO: 46375 - DNA, 201 bp, Homo sapiens
ctgctccccctccccatttcccccctgtcaaagtgattaggtgaatcaagaggaaacaaataaaggtgcttgaaaaagtgaacctaatcacacactttctrgttggtgtttgtgggcactaaaaagcattatatgcatgtggtttgaggttttaatatgtgaaatttattcacctttaatatcttttttgatttaaatata

SEQ ID NO: 46376 - DNA, 201 bp, Homo sapiens
actgaagttcccaatgcccttggcagcaccaaaaaaataacatattaataaggcgaatggttcttaacaattcctttcaagccctgttttctatgtaacasggtacattattttgaaaaaaatgtgtttattcactttaattagttagaaatcttactcctaaatagaagtatcccagaagatctgatgaaacacctgcca

SEQ ID NO: 46377 - DNA, 201 bp, Homo sapiens
ccaccagttctacattaaaaacaacaacaacaacaacaagaaaaacattgttcccagctttgtttcagaaagaaacaaaacacccttgattggccatcacycagttatgtgtcttggcaccttttctaactctctgtagacaaccaattcatactatgttcaagctctaaatattagtgactgtggtgtcttaatgaccta

SEQ ID NO: 46378 - DNA, 201 bp, Homo sapiens
gtagctgggaccaccggcatacgacaccacatctggctatttaaaaaaagttttttggccaggcttggtggctcacacctgtaatcccagcactttgggargccgaggcaggtggatcacttgaggttgggagttcaagaccactctaaccaacatggagaaacctcatctttactaaaagtacaaaattagccaggcgtg

SEQ ID NO: 46379 - DNA, 201 bp, Homo sapiens
tcaaataacatacatgaagtcatgccttcttagtgggtgatgtgggattcaaaccctggtttattacttcacaagaccacatgcttctcattataccataytctttatagatgtagaaggagacatcagaataaagctggtagaatttacccgagccttaaccctactcttcccccaactcaaaaatgtttatctgttgaa

SEQ ID NO: 46380 - DNA, 201 bp, Homo sapiens
cagacctgtttctgtatagcctatgtaaaaaatgttttttacattttaaaaatcttttgtaaatttttaaatttgtaattgttgtgggtacatagtaggtrtatatatttatggggtacatgggacgttttgatacaggcatgcgatgtgaaataagcacatcatgtaacatggggtatccatcccctcaagcatttatcc

SEQ ID NO: 46381 - DNA, 201 bp, Homo sapiens
cagttgggcggttgtccgccttccttacctcatggcaagaaccatgtcctctttgaccttgtgtccctttttactagcacttaattgatgcttgatgtatrtttggacaatggtttgtcctggacttgattttccctgtagctgggatagttagcttgagaatacaggggtacatatgatacagaaaataatgcaaagcag

SEQ ID NO: 46382 - DNA, 201 bp, Homo sapiens
aataagcttagataattttcaccctaagggtaaatctcccaaataatgtttccccatcttctcagagagcccacagtctgaacgaggagaaagctgttcartgaaaaatcaataagtagtcaggtgaatcctccaggaatctgcacagagtggcagtgccacaccttttacataaaccaacctcctcactctcccctcctc

SEQ ID NO: 46383 - DNA, 201 bp, Homo sapiens
actacaggtgcttgccaccacacctggctaatttttgtgggttttttttttttttttttgtatttttagtagagacggggtttcgccatgttggccaggcyggtcttgaactcctgacctcaagtgatctgcccaccttggcctcccaatgtgctgggattacaggcgtgagccaccacacctggcctcatcctgcttctt

SEQ ID NO: 46384 - DNA, 201 bp, Homo sapiens
ctcccgagtagctggaactacaggtgcttgccaccacacctggctaatttttgtgggttttttttttttttttttgtatttttagtagagacggggtttcrccatgttggccaggctggtcttgaactcctgacctcaagtgatctgcccaccttggcctcccaatgtgctgggattacaggcgtgagccaccacacctgg

SEQ ID NO: 46385 - DNA, 201 bp, Homo sapiens
ggtccaagcgattcttgtgcctcagcctcccgagtagctggaactacaggtgcttgccaccacacctggctaatttttgtgggttttttttttttttttttgtatttttagtagagacggggtttcgccatgttggccaggctggtcttgaactcctgacctcaagtgatctgcccaccttggcctcccaatgtgctggga

SEQ ID NO: 46386 - DNA, 201 bp, Homo sapiens
gggtccaagcgattcttgtgcctcagcctcccgagtagctggaactacaggtgcttgccaccacacctggctaatttttgtgggttttttttttttttttttgtatttttagtagagacggggtttcgccatgttggccaggctggtcttgaactcctgacctcaagtgatctgcccaccttggcctcccaatgtgctggg

SEQ ID NO: 46387 - DNA, 201 bp, Homo sapiens
tgggtccaagcgattcttgtgcctcagcctcccgagtagctggaactacaggtgcttgccaccacacctggctaatttttgtgggttttttttttttttttttgtatttttagtagagacggggtttcgccatgttggccaggctggtcttgaactcctgacctcaagtgatctgcccaccttggcctcccaatgtgctgg

SEQ ID NO: 46388 - DNA, 201 bp, Homo sapiens
ctgggtccaagcgattcttgtgcctcagcctcccgagtagctggaactacaggtgcttgccaccacacctggctaatttttgtgggttttttttttttttttttgtatttttagtagagacggggtttcgccatgttggccaggctggtcttgaactcctgacctcaagtgatctgcccaccttggcctcccaatgtgctg

SEQ ID NO: 46389 - DNA, 201 bp, Homo sapiens
tgatcgtgagtctcacaagatctgatggttctataagaaggagctcccccgcacaagttttctcttccctgccaccatgtaggatgtgacgttcctccttcgccttccaccatgattgtgaggcctccctagccatgtggaactgtgagtccattaaacctccttcctttataaattccccagtcttgggtatgtctttat

SEQ ID NO: 46390 - DNA, 201 bp, Homo sapiens
aaggaacaccaccacattaaatgtgactcatctcagtctcagaagctgtggtgtgctggaacttgcttgcaaaagctcaagagagctttcccgttgcaatytggggaagtgaatgacaacacattggtagttttggtagtttagaatcagccaagttgggagtatttacaccacagaaaatgacaaatgctacaaatcagc

SEQ ID NO: 46391 - DNA, 201 bp, Homo sapiens
ccaacctccacctcctgggtccaagcgattcttgtgcctcagcctcccgagtagctggaactacaggtgcttgccaccacacctggctaatttttgtgggktttttttttttttttttgtatttttagtagagacggggtttcgccatgttggccaggctggtcttgaactcctgacctcaagtgatctgcccaccttggc

SEQ ID NO: 46392 - DNA, 201 bp, Homo sapiens
gtgaccacgtggattgagggagaattgcaagattggcctaagcaaaactcaaaggcagaaatgtccagattttctcccttgtcaagtgttcttcactggargccagactctcgctatcattccagggtgtccctctggggaaagggaaggaacaccaccacattaaatgtgactcatctcagtctcagaagctgtggtgtg

SEQ ID NO: 46393 - DNA, 201 bp, Homo sapiens
tgttacccaggctggagtgcagtggcacaatcttggctcattccaacctccacctcctgggtccaagcgattcttgtgcctcagcctcccgagtagctggractacaggtgcttgccaccacacctggctaatttttgtgggttttttttttttttttttgtatttttagtagagacggggtttcgccatgttggccaggc

SEQ ID NO: 46394 - DNA, 201 bp, Homo sapiens
ccagacttcttaatcactataaaatggaagaaaaagaatttgaaccctgaaaggctggcttcaggaatatgtcctgtctaacttttaaaatggactgttcrttgattatcaaacatatgctcaatctctctttttttttttttttttttttgaggtggagttttgctcttgttgtccagctggagtgcaatggcgcgatct

SEQ ID NO: 46395 - DNA, 201 bp, Homo sapiens
gttcgttgattatcaaacatatgctcaatctctctttttttttttttttttttttgaggtggagttttgctcttgttgtccagctggagtgcaatggcgcratctcagctcactgcaacctctgcctcctgggttcaagtgattctcctgccttaccctcctgagtagctgggattacaggcacccgccaccacgcctggc

SEQ ID NO: 46396 - DNA, 201 bp, Homo sapiens
ggagtgcaatggcgcgatctcagctcactgcaacctctgcctcctgggttcaagtgattctcctgccttaccctcctgagtagctgggattacaggcaccygccaccacgcctggctaatttttgcatttttagtagatggggtttcaccatgttgaccaggctggtctcaaactcctgacctcaggtgatccacccgcct

SEQ ID NO: 46397 - DNA, 201 bp, Homo sapiens
cacgatcttggctcattgcaacctctgcctcctgggttcaagagattctcctgtcttagcctctggagtagctgggattacaggcacacgccaccatgccmagctaattttttgtatttttagtagagatgggggtttcaccatgttggccagggtggtctcaaactcctgacctcaggtgatccacccacctcagcctcc

SEQ ID NO: 46398 - DNA, 201 bp, Homo sapiens
gtggcacgatcttggctcattgcaacctctgcctcctgggttcaagagattctcctgtcttagcctctggagtagctgggattacaggcacacgccaccaygccaagctaattttttgtatttttagtagagatgggggtttcaccatgttggccagggtggtctcaaactcctgacctcaggtgatccacccacctcagc

SEQ ID NO: 46399 - DNA, 201 bp, Homo sapiens
gagtttcgctcttgttgcccaggctggagtacagtggcacgatcttggctcattgcaacctctgcctcctgggttcaagagattctcctgtcttagcctcyggagtagctgggattacaggcacacgccaccatgccaagctaattttttgtatttttagtagagatgggggtttcaccatgttggccagggtggtctcaa

SEQ ID NO: 46400 - DNA, 201 bp, Homo sapiens
aaaagttgatagataaaaaatgaaaaagatatataatgtgaatgctacctaaaataagactgatgtctattaatattagacaaactacttagggcaaaaarcatcatcacacagttaaagagagtcacttttaatgatgtaaaaaaacccaattcattagtaatatataaaaattctaaattagtatatacttaataaaat

SEQ ID NO: 46401 - DNA, 201 bp, Homo sapiens
ctcccaggcctgaggacgggcagcgtcactttctcccaagaacgatggagaatcatttctcaccagtaagaatgttggcctcacattaaattcgtgatgtytaatgggcttatttatgtatttatttatttttgaaatggagtttcgctcttgttgcccaggctggagtacagtggcacgatcttggctcattgcaacctc

SEQ ID NO: 46402 - DNA, 201 bp, Homo sapiens
caggagatagataaatctacaaccataatggggggttttagtgtacaatctaaaaaatcagtaaagatatataaggcttgagaaacactaccagcaatctytaccttctggatggctatacatcacccaagaatcacattttgaatcaagcatccatggaacatttactttgtaagctaggtcacaaacaaatctcaataa

SEQ ID NO: 46403 - DNA, 201 bp, Homo sapiens
agtggcagtgccacaccttttacataaaccaacctcctcactctcccctcctcagcagctcccaggcctgaggacgggcagcgtcactttctcccaagaamgatggagaatcatttctcaccagtaagaatgttggcctcacattaaattcgtgatgtttaatgggcttatttatgtatttatttatttttgaaatggagt

SEQ ID NO: 46404 - DNA, 201 bp, Homo sapiens
tgtggaatgcaagtgaagcagtatttagaggaaagttataaccataaaatgtattttaaaaaagaagaatgagaattcatcacccaagcatgatctcaaayaaacagaaaaagaatagcaaattaaaaccaaagaaatagtaaagcaagccttcatgaaacaggaaacagagaacatcaagaaagctaaaagttgtttctt

SEQ ID NO: 46405 - DNA, 201 bp, Homo sapiens
tcccactgtgtccctcccacaacacgtgggcattatgggagccacaattcaagatgagaattgggtgaggacacagccaaaccatatcaacttgtatatgstggcattatagagacagatacagccagtcacacagggaaaggaaaaagatttgaacaaagcctagaaacaactacttgatgtagccagaaaacatgctgt

SEQ ID NO: 46406 - DNA, 201 bp, Homo sapiens
agaaaacatcctgcttcttgttagctcacctccagtttccaacagcctgcggtcagaaccacctggagccttccccgttttccaccccctgcgtccttgcscctacccacaccggggatgttgctgactcccttgctgtagcaagctctgaatactgtttctcatttgggtggttttccttcatttctacgtttgagctac

SEQ ID NO: 46407 - DNA, 201 bp, Homo sapiens
gcgcccctccgacctcggaaagagtcctgggtgcgggattcctggtagccgactcgtcgtctgaccagggccgtgcccgcatcttcctaaggcactggttscggccctggggagactggaattgagacgacagggcctccgctgaccagtccttggacacaacgcggagcggggctgaggggccgccctgccaggcctgcg

SEQ ID NO: 46408 - DNA, 201 bp, Homo sapiens
accagtcacagaaaacatcctgcttcttgttagctcacctccagtttccaacagcctgcggtcagaaccacctggagccttccccgttttccaccccctgsgtccttgcgcctacccacaccggggatgttgctgactcccttgctgtagcaagctctgaatactgtttctcatttgggtggttttccttcatttctacgt

SEQ ID NO: 46409 - DNA, 201 bp, Homo sapiens
ttaaaattacctcccaccgtacaaccctcggtgtctagggttgtaattttaattttttttccaacttttacacagtgactatcaccaaaaaagcgaggtgttttttttttgttttttgtttttggagacagtctcgctcagtcgcccaggctggagtgcagtggcgtgattctcctgcctcagcctctccagtagctggga

SEQ ID NO: 46410 - DNA, 201 bp, Homo sapiens
ccaacagcctgcggtcagaaccacctggagccttccccgttttccaccccctgcgtccttgcgcctacccacaccggggatgttgctgactcccttgctgwagcaagctctgaatactgtttctcatttgggtggttttccttcatttctacgtttgagctactgtggctgagaacagaaagcatctgcaaaaaatgtttt

SEQ ID NO: 46411 - DNA, 201 bp, Homo sapiens
gcttcttgttagctcacctccagtttccaacagcctgcggtcagaaccacctggagccttccccgttttccaccccctgcgtccttgcgcctacccacacsggggatgttgctgactcccttgctgtagcaagctctgaatactgtttctcatttgggtggttttccttcatttctacgtttgagctactgtggctgagaa

SEQ ID NO: 46412 - DNA, 201 bp, Homo sapiens
gaaaacatcctgcttcttgttagctcacctccagtttccaacagcctgcggtcagaaccacctggagccttccccgttttccaccccctgcgtccttgcgyctacccacaccggggatgttgctgactcccttgctgtagcaagctctgaatactgtttctcatttgggtggttttccttcatttctacgtttgagctact

SEQ ID NO: 46413 - DNA, 201 bp, Homo sapiens; identical to SEQ ID NO: 41919

SEQ ID NO: 46414 - DNA, 201 bp, Homo sapiens; identical to SEQ ID NO: 41696

SEQ ID NO: 46415 - DNA, 201 bp, Homo sapiens; identical to SEQ ID NO: 41697

SEQ ID NO: 46416 - DNA, 201 bp, Homo sapiens; identical to SEQ ID NO: 40871

SEQ ID NO: 46417 - DNA, 201 bp, Homo sapiens; identical to SEQ ID NO: 41698

SEQ ID NO: 46418 - DNA, 201 bp, Homo sapiens; identical to SEQ ID NO: 42690

SEQ ID NO: 46419 - DNA, 201 bp, Homo sapiens; identical to SEQ ID NO: 41142

SEQ ID NO: 46420 - DNA, 201 bp, Homo sapiens; identical to SEQ ID NO: 42693

SEQ ID NO: 46421 - DNA, 201 bp, Homo sapiens; identical to SEQ ID NO: 42694

SEQ ID NO: 46422 - DNA, 201 bp, Homo sapiens; identical to SEQ ID NO: 41144

SEQ ID NO: 46423 - DNA, 201 bp, Homo sapiens; identical to SEQ ID NO: 42697

SEQ ID NO: 46424 - DNA, 201 bp, Homo sapiens; identical to SEQ ID NO: 42700

SEQ ID NO: 46425 - DNA, 201 bp, Homo sapiens; identical to SEQ ID NO: 42703

SEQ ID NO: 46426 - DNA, 201 bp, Homo sapiens; identical to SEQ ID NO: 42705

SEQ ID NO: 46427 - DNA, 201 bp, Homo sapiens; identical to SEQ ID NO: 41150

SEQ ID NO: 46428 - DNA, 201 bp, Homo sapiens; identical to SEQ ID NO: 41028

SEQ ID NO: 46429 - DNA, 201 bp, Homo sapiens; identical to SEQ ID NO: 41029

SEQ ID NO: 46430 - DNA, 201 bp, Homo sapiens; identical to SEQ ID NO: 41030

SEQ ID NO: 46431 - DNA, 201 bp, Homo sapiens; identical to SEQ ID NO: 41705

SEQ ID NO: 46432 - DNA, 201 bp, Homo sapiens; identical to SEQ ID NO: 41031

SEQ ID NO: 46433 - DNA, 201 bp, Homo sapiens; identical to SEQ ID NO: 41707

SEQ ID NO: 46434 - DNA, 201 bp, Homo sapiens; identical to SEQ ID NO: 40664

SEQ ID NO: 46435 - DNA, 201 bp, Homo sapiens; identical to SEQ ID NO: 41709

SEQ ID NO: 46436 - DNA, 201 bp, Homo sapiens; identical to SEQ ID NO: 41710

SEQ ID NO: 46437 - DNA, 201 bp, Homo sapiens; identical to SEQ ID NO: 41712

SEQ ID NO: 46438 - DNA, 201 bp, Homo sapiens; identical to SEQ ID NO: 41714

SEQ ID NO: 46439 - DNA, 201 bp, Homo sapiens; identical to SEQ ID NO: 42904

SEQ ID NO: 46440 - DNA, 201 bp, Homo sapiens; identical to SEQ ID NO: 41716

SEQ ID NO: 46441 - DNA, 201 bp, Homo sapiens; identical to SEQ ID NO: 42906

SEQ ID NO: 46442 - DNA, 201 bp, Homo sapiens; identical to SEQ ID NO: 42908

SEQ ID NO: 46443 - DNA, 201 bp, Homo sapiens; identical to SEQ ID NO: 42709

SEQ ID NO: 46444 - DNA, 201 bp, Homo sapiens; identical to SEQ ID NO: 43114

SEQ ID NO: 46445 - DNA, 201 bp, Homo sapiens; identical to SEQ ID NO: 42717

SEQ ID NO: 46446 - DNA, 201 bp, Homo sapiens; identical to SEQ ID NO: 42719

SEQ ID NO: 46447 - DNA, 201 bp, Homo sapiens; identical to SEQ ID NO: 42721

SEQ ID NO: 46448 - DNA, 201 bp, Homo sapiens; identical to SEQ ID NO: 42723

SEQ ID NO: 46449 - DNA, 201 bp, Homo sapiens; identical to SEQ ID NO: 42724

SEQ ID NO: 46450 - DNA, 201 bp, Homo sapiens; identical to SEQ ID NO: 42725

SEQ ID NO: 46451 - DNA, 201 bp, Homo sapiens; identical to SEQ ID NO: 40678

SEQ ID NO: 46452 - DNA, 201 bp, Homo sapiens; identical to SEQ ID NO: 40677

SEQ ID NO: 46453 - DNA, 201 bp, Homo sapiens; identical to SEQ ID NO: 40685

SEQ ID NO: 46454 - DNA, 201 bp, Homo sapiens; identical to SEQ ID NO: 41735

SEQ ID NO: 46455 - DNA, 201 bp, Homo sapiens; identical to SEQ ID NO: 41737

SEQ ID NO: 46456 - DNA, 201 bp, Homo sapiens; identical to SEQ ID NO: 41739

SEQ ID NO: 46457 - DNA, 201 bp, Homo sapiens; identical to SEQ ID NO: 41741

SEQ ID NO: 46458 - DNA, 201 bp, Homo sapiens; identical to SEQ ID NO: 42927

SEQ ID NO: 46459 - DNA, 201 bp, Homo sapiens; identical to SEQ ID NO: 41743

SEQ ID NO: 46460 - DNA, 201 bp, Homo sapiens; identical to SEQ ID NO: 41742

SEQ ID NO: 46461 - DNA, 201 bp, Homo sapiens; identical to SEQ ID NO: 42930

SEQ ID NO: 46462 - DNA, 201 bp, Homo sapiens; identical to SEQ ID NO: 42931

SEQ ID NO: 46463 - DNA, 201 bp, Homo sapiens; identical to SEQ ID NO: 41746

SEQ ID NO: 46464 - DNA, 201 bp, Homo sapiens; identical to SEQ ID NO: 42934

SEQ ID NO: 46465 - DNA, 201 bp, Homo sapiens; identical to SEQ ID NO: 41750

SEQ ID NO: 46466 - DNA, 201 bp, Homo sapiens; identical to SEQ ID NO: 40930

SEQ ID NO: 46467 - DNA, 201 bp, Homo sapiens; identical to SEQ ID NO: 40931

SEQ ID NO: 46468 - DNA, 201 bp, Homo sapiens; identical to SEQ ID NO: 40932

SEQ ID NO: 46469 - DNA, 201 bp, Homo sapiens; identical to SEQ ID NO: 40933

SEQ ID NO: 46470 - DNA, 201 bp, Homo sapiens; identical to SEQ ID NO: 40934

SEQ ID NO: 46471 - DNA, 201 bp, Homo sapiens; identical to SEQ ID NO: 42733

SEQ ID NO: 46472 - DNA, 201 bp, Homo sapiens; identical to SEQ ID NO: 42735

SEQ ID NO: 46473 - DNA, 201 bp, Homo sapiens; identical to SEQ ID NO: 42737

SEQ ID NO: 46474 - DNA, 201 bp, Homo sapiens; identical to SEQ ID NO: 41604

SEQ ID NO: 46475 - DNA, 201 bp, Homo sapiens; identical to SEQ ID NO: 41606

SEQ ID NO: 46476 - DNA, 201 bp, Homo sapiens; identical to SEQ ID NO: 42744

SEQ ID NO: 46477 - DNA, 201 bp, Homo sapiens; identical to SEQ ID NO: 41608

SEQ ID NO: 46478 - DNA, 201 bp, Homo sapiens; identical to SEQ ID NO: 42749

SEQ ID NO: 46479 - DNA, 201 bp, Homo sapiens; identical to SEQ ID NO: 41789

SEQ ID NO: 46480 - DNA, 201 bp, Homo sapiens; identical to SEQ ID NO: 41792

SEQ ID NO: 46481 - DNA, 201 bp, Homo sapiens; identical to SEQ ID NO: 41794

SEQ ID NO: 46482 - DNA, 201 bp, Homo sapiens; identical to SEQ ID NO: 41610

SEQ ID NO: 46483 - DNA, 201 bp, Homo sapiens; identical to SEQ ID NO: 40944

SEQ ID NO: 46484 - DNA, 201 bp, Homo sapiens; identical to SEQ ID NO: 40945

SEQ ID NO: 46485 - DNA, 201 bp, Homo sapiens; identical to SEQ ID NO: 41615

SEQ ID NO: 46486 - DNA, 201 bp, Homo sapiens; identical to SEQ ID NO: 40946

SEQ ID NO: 46487 - DNA, 201 bp, Homo sapiens; identical to SEQ ID NO: 41617

SEQ ID NO: 46488 - DNA, 201 bp, Homo sapiens; identical to SEQ ID NO: 40726

SEQ ID NO: 46489 - DNA, 201 bp, Homo sapiens; identical to SEQ ID NO: 41619

SEQ ID NO: 46490 - DNA, 201 bp, Homo sapiens; identical to SEQ ID NO: 41622

SEQ ID NO: 46491 - DNA, 201 bp, Homo sapiens; identical to SEQ ID NO: 40947

SEQ ID NO: 46492 - DNA, 201 bp, Homo sapiens; identical to SEQ ID NO: 41624

SEQ ID NO: 46493 - DNA, 201 bp, Homo sapiens; identical to SEQ ID NO: 41626

SEQ ID NO: 46494 - DNA, 201 bp, Homo sapiens; identical to SEQ ID NO: 41628

SEQ ID NO: 46495 - DNA, 201 bp, Homo sapiens; identical to SEQ ID NO: 41630

SEQ ID NO: 46496 - DNA, 201 bp, Homo sapiens; identical to SEQ ID NO: 42185

SEQ ID NO: 46497 - DNA, 201 bp, Homo sapiens; identical to SEQ ID NO: 42186

SEQ ID NO: 46498 - DNA, 201 bp, Homo sapiens; identical to SEQ ID NO: 42775

SEQ ID NO: 46499 - DNA, 201 bp, Homo sapiens; identical to SEQ ID NO: 41223

SEQ ID NO: 46500 - DNA, 201 bp, Homo sapiens; identical to SEQ ID NO: 41224

SEQ ID NO: 46501 - DNA, 201 bp, Homo sapiens; identical to SEQ ID NO: 41640

SEQ ID NO: 46502 - DNA, 201 bp, Homo sapiens; identical to SEQ ID NO: 41641

SEQ ID NO: 46503 - DNA, 201 bp, Homo sapiens; identical to SEQ ID NO: 41642

SEQ ID NO: 46504 - DNA, 201 bp, Homo sapiens; identical to SEQ ID NO: 41643

SEQ ID NO: 46505 - DNA, 201 bp, Homo sapiens; identical to SEQ ID NO: 41644

SEQ ID NO: 46506 - DNA, 201 bp, Homo sapiens; identical to SEQ ID NO: 41645

SEQ ID NO: 46507 - DNA, 201 bp, Homo sapiens; identical to SEQ ID NO: 41646

SEQ ID NO: 46508 - DNA, 201 bp, Homo sapiens; identical to SEQ ID NO: 41647

SEQ ID NO: 46509 - DNA, 201 bp, Homo sapiens; identical to SEQ ID NO: 41649

SEQ ID NO: 46510 - DNA, 201 bp, Homo sapiens; identical to SEQ ID NO: 41650

SEQ ID NO: 46511 - DNA, 201 bp, Homo sapiens; identical to SEQ ID NO: 41652

SEQ ID NO: 46512 - DNA, 201 bp, Homo sapiens; identical to SEQ ID NO: 42617

SEQ ID NO: 46513 - DNA, 201 bp, Homo sapiens; identical to SEQ ID NO: 42621

SEQ ID NO: 46514 - DNA, 201 bp, Homo sapiens; identical to SEQ ID NO: 42622

SEQ ID NO: 46515 - DNA, 201 bp, Homo sapiens; identical to SEQ ID NO: 41259

SEQ ID NO: 46516 - DNA, 201 bp, Homo sapiens; identical to SEQ ID NO: 42625

SEQ ID NO: 46517 - DNA, 201 bp, Homo sapiens; identical to SEQ ID NO: 42627

SEQ ID NO: 46518 - DNA, 201 bp, Homo sapiens; identical to SEQ ID NO: 42631

SEQ ID NO: 46519 - DNA, 201 bp, Homo sapiens; identical to SEQ ID NO: 42634

SEQ ID NO: 46520 - DNA, 201 bp, Homo sapiens; identical to SEQ ID NO: 42029

SEQ ID NO: 46521 - DNA, 201 bp, Homo sapiens; identical to SEQ ID NO: 42797

SEQ ID NO: 46522 - DNA, 201 bp, Homo sapiens; identical to SEQ ID NO: 40979

SEQ ID NO: 46523 - DNA, 201 bp, Homo sapiens; identical to SEQ ID NO: 40980

SEQ ID NO: 46524 - DNA, 201 bp, Homo sapiens; identical to SEQ ID NO: 40981

SEQ ID NO: 46525 - DNA, 201 bp, Homo sapiens; identical to SEQ ID NO: 41656

SEQ ID NO: 46526 - DNA, 201 bp, Homo sapiens; identical to SEQ ID NO: 41657

SEQ ID NO: 46527 - DNA, 201 bp, Homo sapiens; identical to SEQ ID NO: 41658

SEQ ID NO: 46528 - DNA, 201 bp, Homo sapiens; identical to SEQ ID NO: 40982

SEQ ID NO: 46529 - DNA, 201 bp, Homo sapiens; identical to SEQ ID NO: 41659

SEQ ID NO: 46530 - DNA, 201 bp, Homo sapiens; identical to SEQ ID NO: 40983

SEQ ID NO: 46531 - DNA, 201 bp, Homo sapiens; identical to SEQ ID NO: 40984

SEQ ID NO: 46532 - DNA, 201 bp, Homo sapiens; identical to SEQ ID NO: 41660

SEQ ID NO: 46533 - DNA, 201 bp, Homo sapiens; identical to SEQ ID NO: 41661

SEQ ID NO: 46534 - DNA, 201 bp, Homo sapiens; identical to SEQ ID NO: 42639

SEQ ID NO: 46535 - DNA, 201 bp, Homo sapiens; identical to SEQ ID NO: 42641

SEQ ID NO: 46536 - DNA, 201 bp, Homo sapiens; identical to SEQ ID NO: 42644

SEQ ID NO: 46537 - DNA, 201 bp, Homo sapiens; identical to SEQ ID NO: 42648

SEQ ID NO: 46538 - DNA, 201 bp, Homo sapiens; identical to SEQ ID NO: 42651

SEQ ID NO: 46539 - DNA, 201 bp, Homo sapiens; identical to SEQ ID NO: 42653

SEQ ID NO: 46540 - DNA, 201 bp, Homo sapiens; identical to SEQ ID NO: 41667

SEQ ID NO: 46541 - DNA, 201 bp, Homo sapiens; identical to SEQ ID NO: 42657

SEQ ID NO: 46542 - DNA, 201 bp, Homo sapiens; identical to SEQ ID NO: 42658

SEQ ID NO: 46543 - DNA, 201 bp, Homo sapiens; identical to SEQ ID NO: 41002

SEQ ID NO: 46544 - DNA, 201 bp, Homo sapiens; identical to SEQ ID NO: 41003

SEQ ID NO: 46545 - DNA, 201 bp, Homo sapiens; identical to SEQ ID NO: 41669

SEQ ID NO: 46546 - DNA, 201 bp, Homo sapiens; identical to SEQ ID NO: 41670

SEQ ID NO: 46547 - DNA, 201 bp, Homo sapiens; identical to SEQ ID NO: 41671

SEQ ID NO: 46548 - DNA, 201 bp, Homo sapiens; identical to SEQ ID NO: 41672

SEQ ID NO: 46549 - DNA, 201 bp, Homo sapiens; identical to SEQ ID NO: 41004

SEQ ID NO: 46550 - DNA, 201 bp, Homo sapiens; identical to SEQ ID NO: 41673

SEQ ID NO: 46551 - DNA, 201 bp, Homo sapiens; identical to SEQ ID NO: 41674

SEQ ID NO: 46552 - DNA, 201 bp, Homo sapiens; identical to SEQ ID NO: 41675

SEQ ID NO: 46553 - DNA, 201 bp, Homo sapiens; identical to SEQ ID NO: 41676

SEQ ID NO: 46554 - DNA, 201 bp, Homo sapiens; identical to SEQ ID NO: 41677

SEQ ID NO: 46555 - DNA, 201 bp, Homo sapiens; identical to SEQ ID NO: 42848

SEQ ID NO: 46556 - DNA, 201 bp, Homo sapiens; identical to SEQ ID NO: 42851

SEQ ID NO: 46557 - DNA, 201 bp, Homo sapiens; identical to SEQ ID NO: 41678

SEQ ID NO: 46558 - DNA, 201 bp, Homo sapiens; identical to SEQ ID NO: 41681

SEQ ID NO: 46559 - DNA, 201 bp, Homo sapiens; identical to SEQ ID NO: 42665

SEQ ID NO: 46560 - DNA, 201 bp, Homo sapiens; identical to SEQ ID NO: 42668

SEQ ID NO: 46561 - DNA, 201 bp, Homo sapiens; identical to SEQ ID NO: 42670

SEQ ID NO: 46562 - DNA, 201 bp, Homo sapiens; identical to SEQ ID NO: 42672

SEQ ID NO: 46563 - DNA, 201 bp, Homo sapiens; identical to SEQ ID NO: 42675

SEQ ID NO: 46564 - DNA, 201 bp, Homo sapiens; identical to SEQ ID NO: 41111

SEQ ID NO: 46565 - DNA, 201 bp, Homo sapiens; identical to SEQ ID NO: 42677

SEQ ID NO: 46566 - DNA, 201 bp, Homo sapiens; identical to SEQ ID NO: 42679

SEQ ID NO: 46567 - DNA, 201 bp, Homo sapiens; identical to SEQ ID NO: 42681

SEQ ID NO: 46568 - DNA, 201 bp, Homo sapiens; identical to SEQ ID NO: 42683

SEQ ID NO: 46569 - DNA, 201 bp, Homo sapiens; identical to SEQ ID NO: 41019

SEQ ID NO: 46570 - DNA, 201 bp, Homo sapiens; identical to SEQ ID NO: 41021

SEQ ID NO: 46571 - DNA, 201 bp, Homo sapiens; identical to SEQ ID NO: 41023

SEQ ID NO: 46572 - DNA, 201 bp, Homo sapiens; identical to SEQ ID NO: 41686

SEQ ID NO: 46573 - DNA, 201 bp, Homo sapiens; identical to SEQ ID NO: 41024

SEQ ID NO: 46574 - DNA, 201 bp, Homo sapiens; identical to SEQ ID NO: 41688

SEQ ID NO: 46575 - DNA, 201 bp, Homo sapiens; identical to SEQ ID NO: 41025

SEQ ID NO: 46576 - DNA, 201 bp, Homo sapiens; identical to SEQ ID NO: 41690

SEQ ID NO: 46577 - DNA, 201 bp, Homo sapiens; identical to SEQ ID NO: 41026

SEQ ID NO: 46578 - DNA, 201 bp, Homo sapiens; identical to SEQ ID NO: 41692

SEQ ID NO: 46579 - DNA, 201 bp, Homo sapiens; identical to SEQ ID NO: 42881

SEQ ID NO: 46580 - DNA, 201 bp, Homo sapiens; identical to SEQ ID NO: 41693

SEQ ID NO: 46581 - DNA, 201 bp, Homo sapiens; identical to SEQ ID NO: 41694

SEQ ID NO: 46582 - DNA, 201 bp, Homo sapiens; identical to SEQ ID NO: 42884

SEQ ID NO: 46583 - DNA, 201 bp, Homo sapiens; identical to SEQ ID NO: 41695

SEQ ID NO: 46584 - DNA, 201 bp, Homo sapiens
ggcagcaaggaaatgcaaagcaaacatctacaaatatttgaatccacctgtccctcacctaccaacttccccctctactactcataaagtggtaggactcmtaatgccccgcttccttccacctgagaaccaaccagcaccctgatatttcaaagccagacctaaagaaccatggttgccaataacctcaatgccaaacca

SEQ ID NO: 46585 - DNA, 201 bp, Homo sapiens
aaatagctcttgtaaaagcatcagttgggaaagagtttatgagttcctctttgtcctctcctctggagaaaagacagaacatgcaagaacactagatacaycaagctatgggtgttgaaatagactagctggtgacctggatttgcaaataccctagggacatgaaaacattttttctttttctttttcttttttgtaacc

SEQ ID NO: 46586 - DNA, 201 bp, Homo sapiens; identical to SEQ ID NO: 30463

SEQ ID NO: 46587 - DNA, 201 bp, Homo sapiens
ctgcttgctttcttatcaccagaatactagtcaatctgatttcttagttccatgtcttttcttccaaggaggtagggcatggggttgggggacactttccrccttccttgcatctcactgtccactcttaaatttttattaagaaacctctgaaagattcaaaattcagttcagtttcaataatcccaaagaagttgggat

SEQ ID NO: 46588 - DNA, 201 bp, Homo sapiens
agaaagtttaggcaatttgctcacattcacacaggcaattagtaacagagctgagttcgggtctggtataggctttttaatttgattctccacaaatgaasactaagataaatagcatttattgcatacccactatttaccagatactgtgcaaagggctttacatatattactttactaaatcctcaccataaactttaa

SEQ ID NO: 46589 - DNA, 201 bp, Homo sapiens
ataatcctctcattttatttcctctcaaggaaaccaagggcaagaaagtttaggcaatttgctcacattcacacaggcaattagtaacagagctgagttcrggtctggtataggctttttaatttgattctccacaaatgaacactaagataaatagcatttattgcatacccactatttaccagatactgtgcaaagggc

SEQ ID NO: 46590 - DNA, 201 bp, Homo sapiens
atcctccaatccctttgaatttgagtttgtcattttaacctttaacagccttttcaggtaaaaataacaaagaccaatttattgactttgtagctacaatragcttgaaaaagcgcttacttaaaagaaagactggaaggaagaaaaaaaaaagaaaatggagtacatactcctcagacgatgcacactttaattagctaa

SEQ ID NO: 46591 - DNA, 201 bp, Homo sapiens
tcctaggggcactggggggcatgcctgtcttaagaatgggcctggcttcttttctctgggcctcccctccttaacatttcagtcctgcttctgccagcccrtcttctccgcatcaccctttgggtggactgttctcccccatggccctgctcccccttctatgccccttgtccgccctgtttctgtgctttcattatatcc

SEQ ID NO: 46592 - DNA, 201 bp, Homo sapiens
gggagattgatttgtaaaagaacaacaacaacatatggcagcaaggaaatgcaaagcaaacatctacaaatatttgaatccacctgtccctcacctaccarcttccccctctactactcataaagtggtaggactcctaatgccccgcttccttccacctgagaaccaaccagcaccctgatatttcaaagccagacctaa

SEQ ID NO: 46593 - DNA, 201 bp, Homo sapiens
ggggtacaaacaccttcacagtcccctgcgggagtacatcagtggaaatatttggggaatgaggctagaaggcaggagatacattcagtttacttatcccyctggtttcttttccccactccttacctgccccacatccctagtgggtgggaaggcatcagaagacagttggctacaatatcagctttctctgctactttg

SEQ ID NO: 46594 - DNA, 201 bp, Homo sapiens
taaaagaacaacaacaacatatggcagcaaggaaatgcaaagcaaacatctacaaatatttgaatccacctgtccctcacctaccaacttccccctctacyactcataaagtggtaggactcctaatgccccgcttccttccacctgagaaccaaccagcaccctgatatttcaaagccagacctaaagaaccatggttgc

SEQ ID NO: 46595 - DNA, 201 bp, Homo sapiens
caatactctcaaagcacccaccctatgcacaccagtttccctcaagggactcaaaaggaatcgaggtagacccttctcagaggctgtttaactacagacayatcaggatatgtactaatacccaaaaccaaaaccaccaccaatgactgcaatagattcactgtctagacccaaggtccaggcagtttcccttttttgcat

SEQ ID NO: 46596 - DNA, 201 bp, Homo sapiens
cagtaagcaatactctcaaagcacccaccctatgcacaccagtttccctcaagggactcaaaaggaatcgaggtagacccttctcagaggctgtttaactrcagacacatcaggatatgtactaatacccaaaaccaaaaccaccaccaatgactgcaatagattcactgtctagacccaaggtccaggcagtttcccttt

SEQ ID NO: 46597 - DNA, 201 bp, Homo sapiens
gtgattttctcatgagttttcaccatgtttaaaagacactgtgccccactctcatcccaaggtctatggtcaacttgactcaatgctcataactttcctcrctgattcctgcttatcctgctcctccaagcacaactgcatttcccaaaggtagatccagtaagcaatactctcaaagcacccaccctatgcacaccagtt

SEQ ID NO: 46598 - DNA, 201 bp, Homo sapiens
agaacatgatccccctggaggacagcaacagccacagcctgaagaaagatccagtgatgccccagaacatgatccccctggaggacagcaacagccacagyctgaagaaagatccaatgatgcaccaggagatggtccccctgggggacagcaacagccatagcctgaagaaagatccagtggtgccccaggacacagctc

SEQ ID NO: 46599 - DNA, 201 bp, Homo sapiens
agcaacagccacagcctgaagaaagatccagtgatgccccagaacatgatccccctggaggacagcaacagccacagtctgaagaaagatccaatgatgcmccaggagatggtccccctgggggacagcaacagccatagcctgaagaaagatccagtggtgccccaggacacagctcccctgatgtttagcaggagacac

SEQ ID NO: 46600 - DNA, 201 bp, Homo sapiens
tccagtggtgccccagggcacagctcccctgacgtttagcaggagacacagcctgaagaaagtgccagtggtgccccaggggacagcctccctggggttcrgcagaatccacagcctgaagaaagagttagtgatgcccgaggagatggtccccctgggggacagcaacagccacagcatgaagaaagatctagtgatgcc

SEQ ID NO: 46601 - DNA, 201 bp, Homo sapiens
caacagccatagcctgaagaaagatccagtggtgccccagggcacagctcccctgatgtttagcaggagacacagcctgaagaaagtgccagtgatgcccmaggagatggtccccctgggggacagcaacagccatagcctgaagaaagatccagtggtgccccagggcacagctcccctgatgtttagcaggagacacag

SEQ ID NO: 46602 - DNA, 201 bp, Homo sapiens
tgaagaaagtgccagtggtgccccaggggacagcctccctggggttcagcagaatccacagcctgaagaaagagttagtgatgcccgaggagatggtcccyctgggggacagcaacagccacagcatgaagaaagatctagtgatgcccaaggagatggtccccctaggggacagcaacagtcacagcctgaagaaagatc

SEQ ID NO: 46603 - DNA, 201 bp, Homo sapiens
ggacagcagaagccacagcctgaagaaagatccagtgatgccccagaacatgatccccctggaggacagcaacagccacagcctgaagaaagatccagtgrtgccccagaacatgatccccctggaggacagcaacagccacagtctgaagaaagatccaatgatgcaccaggagatggtccccctgggggacagcaacag

SEQ ID NO: 46604 - DNA, 201 bp, Homo sapiens
agccacagtctgaagaaagatccaatgatgcaccaggagatggtccccctgggggacagcaacagccatagcctgaagaaagatccagtggtgccccaggrcacagctcccctgatgtttagcaggagacacagcctgaagaaagtgccagtgatgcccaaggagatggtccccctgggggacagccacagcctgaagaaa

SEQ ID NO: 46605 - DNA, 201 bp, Homo sapiens
cccagaagatggtccccctgggggacagcagaagccacagcctgaagaaagatccagtgatgccccagaacatgatccccctggaggacagcaacagccayagcctgaagaaagatccagtgatgccccagaacatgatccccctggaggacagcaacagccacagtctgaagaaagatccaatgatgcaccaggagatgg

SEQ ID NO: 46606 - DNA, 201 bp, Homo sapiens
attgtaaggtgtattattggtaacagcaaaatgaacagcacttactaggcttaaatgtttgctagatgaaaaaaaatgatattggttagaaatatattttsctcaggtcaccaggtttcttattaactactggtggtggcgagagaggtgaatgtcagaaaaaggccagtttttcccatttcctggatttgagaaagttgg

SEQ ID NO: 46607 - DNA, 201 bp, Homo sapiens
ctcctacctcctcccaaaatgcatgaaattcccttcctctgactgataaaccctcactcattctccaagacatatcttctctgtcaaccacatccccaccraagtcacactgcacccgctctccctcccctgcagcatgtggctccctcccatgtacccagcatgcactgttcagccacatatactcacccaccctcctga

SEQ ID NO: 46608 - DNA, 201 bp, Homo sapiens
ctaccaagaagaattcaagaactagtagctgctattgtaaggtgtattattggtaacagcaaaatgaacagcacttactaggcttaaatgtttgctagatkaaaaaaaatgatattggttagaaatatattttgctcaggtcaccaggtttcttattaactactggtggtggcgagagaggtgaatgtcagaaaaaggcca

SEQ ID NO: 46609 - DNA, 201 bp, Homo sapiens
ataacgaatgcagctgcacatcttcaggcccatattgagctcttctctcttttctgcctcctcctgagcccccaagcccaatcaccttggctctggttgtygtgtgccatgatgctccccaggatggtgacaaggtgctgggctctggccttcagtctgagaaccagcttctcccaagctcttgggtccctggcctgagcc

SEQ ID NO: 46610 - DNA, 201 bp, Homo sapiens
atgcatcttagctgaacaataacgaatgcagctgcacatcttcaggcccatattgagctcttctctcttttctgcctcctcctgagcccccaagcccaatyaccttggctctggttgttgtgtgccatgatgctccccaggatggtgacaaggtgctgggctctggccttcagtctgagaaccagcttctcccaagctctt

SEQ ID NO: 46611 - DNA, 201 bp, Homo sapiens
ccagtccttttggcaccactgggtacataaaacaaggtttgagtcagggatgaactcccccaggcaggaggagatagcatcaggatctcagtgaagtgggrtggtatctgagtgcctagcacagtgccccacgcagagctcaatgcatcttagctgaacaataacgaatgcagctgcacatcttcaggcccatattgagct

SEQ ID NO: 46612 - DNA, 201 bp, Homo sapiens
ggtgggcacgtgtgggtcccacctgacagccgtctgcctgttctacggctcggccatctacacctacctgcagcccgcgcagcgctacaaccaggcacggrgcaagttcgtatcgctcttctacaccgtggtcacacctgctctcaacccgctcatctacaccctcaggaataagaaagtgaagggggcagcgaggaggct

SEQ ID NO: 46613 - DNA, 201 bp, Homo sapiens
ctttctcctgctgggtttctccgactggccttccctgcagccggtcctcttcgcccttgtcctcctgtgctacctcctgaccttgacgggcaactcggcgytggtgctgctggcggtgcgcgacccgcgcctgcacacgcccatgtactacttcctctgccacctggccttggtagacgcgggcttcactactagcgtggt

SEQ ID NO: 46614 - DNA, 201 bp, Homo sapiens
caactcggcgctggtgctgctggcggtgcgcgacccgcgcctgcacacgcccatgtactacttcctctgccacctggccttggtagacgcgggcttcactmctagcgtggtgccgccgctgctggccaacctgcgcggaccagcgctctggctgccgcgcagccactgcacggcccagctgtgcgcatcgctggctctggg

SEQ ID NO: 46615 - DNA, 201 bp, Homo sapiens
tggccttggtagacgcgggcttcactactagcgtggtgccgccgctgctggccaacctgcgcggaccagcgctctggctgccgcgcagccactgcacggcscagctgtgcgcatcgctggctctgggttccgccgaatgcgtcctcctggcggtgatggctctggaccgcgcggccgcagtgtgccgcccgctgcgctatg

SEQ ID NO: 46616 - DNA, 201 bp, Homo sapiens
cgcacgctggccagcgcctcctggctaagcggcctcaccaactcggttgcgcaaaccgcgctcctggctgagcggccgctgtgcgcgccccgcctgctggrccacttcatctgtgagctgccggcgttgctcaagctggcctgcggaggcgacggagacactaccgagaaccagatgttcgccgcccgcgtggtcatcctg

SEQ ID NO: 46617 - DNA, 201 bp, Homo sapiens
ctcggttgcgcaaaccgcgctcctggctgagcggccgctgtgcgcgccccgcctgctggaccacttcatctgtgagctgccggcgttgctcaagctggccygcggaggcgacggagacactaccgagaaccagatgttcgccgcccgcgtggtcatcctgctgctgccgtttgccgtcatcctggcctcctacggtgccgt

SEQ ID NO: 46618 - DNA, 201 bp, Homo sapiens
ggcgacggagacactaccgagaaccagatgttcgccgcccgcgtggtcatcctgctgctgccgtttgccgtcatcctggcctcctacggtgccgtggcccragctgtctgttgcatgcggttcagcggaggccggaggagggcggtgggcacgtgtgggtcccacctgacagccgtctgcctgttctacggctcggccatc

SEQ ID NO: 46619 - DNA, 201 bp, Homo sapiens
tcttctggcctcgtctccattttacatgaactgttgcataaataaacacagagtacctgaaacaacggaggtgatcattctgcctaccgagtgttggccasgccaagcttggagtgttgctcttattcttagggagtttatttttaagtaatctcatctgtaaatgggattacaatccacaaactgaccttgtatatgatt

SEQ ID NO: 46620 - DNA, 201 bp, Homo sapiens
ctaccgagaaccagatgttcgccgcccgcgtggtcatcctgctgctgccgtttgccgtcatcctggcctcctacggtgccgtggcccgagctgtctgttgyatgcggttcagcggaggccggaggagggcggtgggcacgtgtgggtcccacctgacagccgtctgcctgttctacggctcggccatctacacctacctgc

SEQ ID NO: 46621 - DNA, 201 bp, Homo sapiens
gcgtggtgccgccgctgctggccaacctgcgcggaccagcgctctggctgccgcgcagccactgcacggcccagctgtgcgcatcgctggctctgggttcsgccgaatgcgtcctcctggcggtgatggctctggaccgcgcggccgcagtgtgccgcccgctgcgctatgcggggctcgtctccccgcgcctatgtcgca

SEQ ID NO: 46622 - DNA, 201 bp, Homo sapiens
tggctctggaccgcgcggccgcagtgtgccgcccgctgcgctatgcggggctcgtctccccgcgcctatgtcgcacgctggccagcgcctcctggctaagyggcctcaccaactcggttgcgcaaaccgcgctcctggctgagcggccgctgtgcgcgccccgcctgctggaccacttcatctgtgagctgccggcgttgc

SEQ ID NO: 46623 - DNA, 201 bp, Homo sapiens
ctgcctgttctacggctcggccatctacacctacctgcagcccgcgcagcgctacaaccaggcacggggcaagttcgtatcgctcttctacaccgtggtcwcacctgctctcaacccgctcatctacaccctcaggaataagaaagtgaagggggcagcgaggaggctgctgcggagtctggggagaggccaggctgggca

SEQ ID NO: 46624 - DNA, 201 bp, Homo sapiens; identical to SEQ ID NO: 22669

SEQ ID NO: 46625 - DNA, 201 bp, Homo sapiens; identical to SEQ ID NO: 22671

SEQ ID NO: 46626 - DNA, 201 bp, Homo sapiens
aaagaccagcgctcatccatgagaacacagatgcgaacgagaggcccaggtaccctcatctgaacaggctgatgctcaggaggggcggctggtgtgggcaygctcacatggggtttgaatccttctgcatttgggagctctctggggatggagtagagccttgtgcatccctgcccacccagcctagcatctgcctgcacg

SEQ ID NO: 46627 - DNA, 201 bp, Homo sapiens
aagtcaaccaaactcaactcctccagcctccagagacagctgggagggtgtggtggggtccctggagggattgagagggagacagctctagcaaaggggamaattctggagcagttgtctctctccacctcactagaatcacttcccgccatcagaagtaaatctgctctttcctgagaagagtctgggtttggtgtgtgt

SEQ ID NO: 46628 - DNA, 201 bp, Homo sapiens
aggctgatgctcaggaggggcggctggtgtgggcacgctcacatggggtttgaatccttctgcatttgggagctctctggggatggagtagagccttgtgyatccctgcccacccagcctagcatctgcctgcacgctgcagccccacctgtttcagcatgtccctcttgtcatccctggggcagcctttccatggggtct

SEQ ID NO: 46629 - DNA, 201 bp, Homo sapiens
ttttttaattagtcaagtgtggtggcatgcacctgtagtcccagctactcaggaggttgaggtgtgaggagctctcgagcctgggagtataagactgcagkgagctactatcacatagttgcacgccagcctgggtgacagggtgaaaccctatccaaataataataataataatttgacaaataaagtctcttttaatgt

SEQ ID NO: 46630 - DNA, 201 bp, Homo sapiens
aagggaggttaagaaattttcatcttcttttttttttttttgatatggaaatccagctctgtcatccagccgggagtgtagtggcatgatctcggctcacygcaacctctcccccctgggttcaagcaattctctgcctcagcctcctgagtagctgagattacaggtgcccgccaccatgcccagctaatttttatattt

SEQ ID NO: 46631 - DNA, 201 bp, Homo sapiens
gtctggccttatggtggtaccacactgttttgattactatagttctgtagtaagttttgaaattgaaagtatggatcctacagctttgttcttttacaatyttgttttggaaattatgatgtatcctgatgtatttgtccttatgtttttgtgtgtgaaattctttgagcttattggatcccagcacgtggcaagtaagag

SEQ ID NO: 46632 - DNA, 201 bp, Homo sapiens
ggagccagggagattgaggctgcggtgagctgtgattataccactgcactccagcctgggtgacagagcaagaccttgtctcaaaaaaaggggagaaaatrttggagctctgtaagaaatgtaattacataacatgactaggctaggaataatagttgcttcatcataatcgtgtaaacactggatattaatctattctca

SEQ ID NO: 46633 - DNA, 201 bp, Homo sapiens
agaaaatattggagctctgtaagaaatgtaattacataacatgactaggctaggaataatagttgcttcatcataatcgtgtaaacactggatattaatcyattctcaattataaaactgtcctgaaggaatccgagaatggaattatatttcctactagtggggaggagcatgggagaggaagaatcttcatttttccac

SEQ ID NO: 46634 - DNA, 201 bp, Homo sapiens
atgttggtcaggctggtctcaaactcctgaccttgtgatctgcctgcctcggcctcccaaagtgctgggattacaggtgtgagccactgcgcctcgtctamtttttaatatttttagtggagacagggtttcaccatgttggccaggctggtcttgaattcctgacctcaagtgatctgcccacctcggcctcccaaagtg

SEQ ID NO: 46635 - DNA, 201 bp, Homo sapiens
tgaggcattaggatcacttgggcccaggagttggaggctgcagtgagccatgattgcactactgcattctagcctggatgactcagtgataccctgtctcaaaaaaaaaaaaaaaaaagacaggagtgatgcttcaggggagataaggaaatcaagaggtcgccagagtgctgtgagcctatcaagagatctgcatgcctg

SEQ ID NO: 46636 - DNA, 201 bp, Homo sapiens
tgtgattataccactgcactccagcctgggtgacagagcaagaccttgtctcaaaaaaaggggagaaaatattggagctctgtaagaaatgtaattacatracatgactaggctaggaataatagttgcttcatcataatcgtgtaaacactggatattaatctattctcaattataaaactgtcctgaaggaatccgaga

SEQ ID NO: 46637 - DNA, 201 bp, Homo sapiens
agtgataccctgtctcaaaaaaaaaaaaaaaaaagacaggagtgatgcttcaggggagataaggaaatcaagaggtcgccagagtgctgtgagcctatcargagatctgcatgcctggtggagagttgggagttgcatcagaacctagaaaacaaagaggccgggcacggtggctcatgcctgtaatcccagcactttggg

SEQ ID NO: 46638 - DNA, 201 bp, Homo sapiens
tctgtagtaagttttgaaattgaaagtatggatcctacagctttgttcttttacaatgttgttttggaaattatgatgtatcctgatgtatttgtccttaygtttttgtgtgtgaaattctttgagcttattggatcccagcacgtggcaagtaagagttccaaaaagaaaacaaggaaggatctcagtaatgaagtaatt

SEQ ID NO: 46639 - DNA, 201 bp, Homo sapiens
  misc_feature (1)...(201): n = A,T,C or G, or insertion/deletion polymorphism (see Tables 1-2)
ggaaacgcgtccgggccaactctcgagagggtttcacccctgcccagtgcgggcactgcccgctcccttccgcccccaggcctcgcaggcccctccggggntgctgcccacccccacttacctttctaggctctgctgacccttcgggattcgcggctagctgtgatgtgtccgccaagatctcttctcttgtctgtaaac

SEQ ID NO: 46640 - DNA, 201 bp, Homo sapiens
cggctagctgtgatgtgtccgccaagatctcttctcttgtctgtaaacaacttcactctcaaggaggcagctctggcctctcagcaggtgcggcctacagygatgtccgtccgggttttacatccttccccgacctcgacatgagtcccagccccctcgggcctctgactctcaggtgtcccctacgatcgccgtcctctc

SEQ ID NO: 46641 - DNA, 201 bp, Homo sapiens
tcaccccaatatcattctctccctcctcctccaactcctccgagcccaggtccgacatggtctcgccccagcctggatcacagccgcagcgcctctagcargtgggtagcaaccgcctccaccgccgcgtcccgcgtcgccatggagacgcggccggtcccgcctccctcccagcccggaagatggggagcggggacaggc

SEQ ID NO: 46642 - DNA, 201 bp, Homo sapiens
gcacctcgaccaatcaccgcccgggaatacggaggggcggggcggaagggacgaggtggagccagtggcagcactctggtgccgtcatagcaacgaggggscgcttcggccaatcactgctcgggaagcgagggggcggggactgggcagggcctgagcgggttctgtgcctggctgcccaccggctctctgacctggacc

SEQ ID NO: 46643 - DNA, 201 bp, Homo sapiens
cttctcttgtctgtaaacaacttcactctcaaggaggcagctctggcctctcagcaggtgcggcctacagtgatgtccgtccgggttttacatccttcccmgacctcgacatgagtcccagccccctcgggcctctgactctcaggtgtcccctacgatcgccgtcctctcctctcgctcctggctcccctacactgtcac

SEQ ID NO: 46644 - DNA, 201 bp, Homo sapiens
cctcgcgtctccagcacaggtccgggtttctccacccaatgcgcctgcgcacaggcctagcccagtcggacgcagcccaggactgccaggggtggggattrcctgggtcccccaggaagggccgggttacgtccggaaaagtgaggcccggggttccagttaattgttaccggaagtggagggaagcgttgccaggggagg

SEQ ID NO: 46645 - DNA, 201 bp, Homo sapiens
ggaaatctgaggaaggagagggatagtctgccttcagagttttgtttttgagataggtctcactgtcacccaggctgagaggctgagatcatagctcactkcgtcctcgcgtctccagcacaggtccgggtttctccacccaatgcgcctgcgcacaggcctagcccagtcggacgcagcccaggactgccaggggtgggg

SEQ ID NO: 46646 - DNA, 201 bp, Homo sapiens
gagatcatagctcactgcgtcctcgcgtctccagcacaggtccgggtttctccacccaatgcgcctgcgcacaggcctagcccagtcggacgcagcccagsactgccaggggtggggattgcctgggtcccccaggaagggccgggttacgtccggaaaagtgaggcccggggttccagttaattgttaccggaagtggag

SEQ ID NO: 46647 - DNA, 201 bp, Homo sapiens
caggggtggggattgcctgggtcccccaggaagggccgggttacgtccggaaaagtgaggcccggggttccagttaattgttaccggaagtggagggaagmgttgccaggggagggcggagactgtggctgacaagatgggtggcaggcccttccctgggggtatcgaggtagggacgtttgtggctacgtctgtcctaga

SEQ ID NO: 46648 - DNA, 201 bp, Homo sapiens
ctctaaaaaataaagtgtctataaaaatcagtcttacttagaccagctgtcaagattctccagttcataaagtgtaatacccacttaaaattttatgtgcytaacggtcaggcgcagtggctcacgcctgtaatcccagcactttcggaggccgaggctggtgaatcccctgaagtcaggagttccagaccagcctgacca

SEQ ID NO: 46649 - DNA, 201 bp, Homo sapiens
aaaagtctggaattttgatacatcctggcagaaagtgcctatgcaaccagctcccaataaaaacctgggacatggaactcaaaagagcttccaaagcagasaacatttcacatgtgctgccacaactttttgctggaggaattgtgcacattctgtgtgattccactggaggaagactcttgaaactctgtgtcagggttc

SEQ ID NO: 46650 - DNA, 201 bp, Homo sapiens
agttgctgggaccacagatgtgtgccactacactgactaatttttttattttttggtagagatggggtcttgctatgttgtccaggttggtctcaaacacytagcctcaagagatcttcttgcctccacctcccaaagtgctgggattacagggatgagccactgtccctagctaaatgaattaaatgtacataaaagctt

SEQ ID NO: 46651 - DNA, 201 bp, Homo sapiens
tgaatcctcaagtgcaggttgaaatagaattgtttattttaacctaaaagctaccttataaaaggatgcaatcacttagaaataacatttaaaagtaaatkaaatctcagagttatgaggcaataatagttgtcttatgaaagacatttactcaataagaaaaagaacacattttaggagctcagttcctacaaattaaat

SEQ ID NO: 46652 - DNA, 201 bp, Homo sapiens
gcacgttctcactcacaagtgggagttgaacaatgagaacacatggacacagggaggggaacatcacatgccagaggctgtcaggggtagggggcaagggragggagagcattaggacaaatacctaatgcatgccgggcttaaaacatagatgacgagttgataggtgcagcaaaccaccacagcacatctatacctatg

SEQ ID NO: 46653 - DNA, 201 bp, Homo sapiens
agatatgaaacagtaatattacaatcatgaaacgacaagcacgataatgacattttaaaggtactgcattagaaatgaactgcatacttccaagacttatygttaagagaacaaaagacagcccacactagttaaggcactaaagttagactactgcaaccttgtagcagaacataattctaatatgatactgtcattacc

SEQ ID NO: 46654 - DNA, 201 bp, Homo sapiens
aggtgccagaccatgctaggcttggtaaatcacaatggagaatttattctagggagaaggcagtgaagaacaacaagatcagttttgcgttttaaaaactygctttggttgcagtggagagaatgaattgcagtagaacatgaacgaaagcagaaggaccaaacgtagcagtccaataatggggcataggagtctgcatta

SEQ ID NO: 46655 - DNA, 201 bp, Homo sapiens
cagatcctaagcggaggagcgacatcagctttgtttttaacaaggtcactctgccctttggagagtggatggtggtgggtaagaatggagataggaagttactgcaataataaagattgggaaaatgggcttactctagtttcggggtggccaagcttttttgtaaagggccaaatggtaagtatcttagactttcaggcc

SEQ ID NO: 46656 - DNA, 201 bp, Homo sapiens
acacttttgcacatccttttaaaatatgaggtttaagaggtgacggctggattctcagacctgcttctgcattccgtgtgttccagttgctttattgaaaygtgtaaggaaaatgtggcgtcacacttccatgtgggcagaagaggggtcatcctggaggctcttagcgatgcaccataactcgccaggtggcagcgtgtt

SEQ ID NO: 46657 - DNA, 201 bp, Homo sapiens
tctcctttataataaaccgctaaactaaagtgtttccctgagatctgcgtgctcagtgagggttgtggacactctgattgatagccagtcagtcagaagcrcaagtaacacaacctgaggcttgccgttggctctcgaagtggggggcagtcttgtgggacagagcactcaacctatgggatttgatgctttctcccagca

SEQ ID NO: 46658 - DNA, 201 bp, Homo sapiens
ttcaaccccaacaactgtaccgtgtgctttttcttgagacagttgtacttggggatgcagcaaaagttcttttgtggcacattttatcacagggttggaaytgaataaagtggtgaattattttaactgttcatcagggaataagctaagcaaaactggcctttttcctttttctttcccttttccctgcctgtgcagggc

SEQ ID NO: 46659 - DNA, 201 bp, Homo sapiens
aggtcagagatgggagagctaggcatgggtcctgggtcgggagaagccaggctgatgactgcatatcgggtccagctcctccttctgccagtggggaaacrggtccagtgaggcaggtggctggctcaggagcaattaaaggctgagttggaccccctaccctagcctcctctcagttcctgtggcttctcagctggttgg

SEQ ID NO: 46660 - DNA, 201 bp, Homo sapiens
cagcatcacccttggggtgagtgggatctcagccccaagttcagtgtgggctgctcccacaactggcacgtttacctggcctttgttggggactttttgcratattatggtatctcagtgacttcccccacttccactctgccttcaggagcccacagggattggacagccccatggaggaactcctgctctggcagcttt

SEQ ID NO: 46661 - DNA, 201 bp, Homo sapiens
ctccgtggactcttttctgggcattgagtagcaggctcagggtctgagcacagggagctccctggagagaatgttgcatctctcacttcccatcccgccaccccgtgtgtagccccctgcctggattcacttcccctggaaagtttctgcccatgaagccccgagggcagaggagagtgaagagtgaatgccacagctggg

SEQ ID NO: 46662 - DNA, 201 bp, Homo sapiens
ctggcacagaacaggcactagtgtgtgtgtttgctgaatgaaagggtatttgagagtttctgtgctgtacgctgctatatggaaatacatgccagatattaaaaaaaaaaaaaacatgatcaagactaggaggcactttgccaaatgcagaggcctgaaatctccaaaaaagagccctttggactgagttcagagcccagt

SEQ ID NO: 46663 - DNA, 201 bp, Homo sapiens
tgaggcaggagaatcacttgaacccaggagatgaggttttcagtgagccgaagttgagccactgcactccagcctgggcgacagggtgaaactctgtctcwataaataaataaataaataaataaataaataaataaataaataaataaaaagtcacgactgtaaatggcagagctgaatatccatagtgatgatctagtt

SEQ ID NO: 46664 - DNA, 201 bp, Homo sapiens
cacgactgtaaatggcagagctgaatatccatagtgatgatctagttggagactcagccctattgccctctaggccacactttttgggcgcacacatccakctgcaagctctccccacctcccccaggcctcattgtgttcgattgaaatagacccctccagtgagaatgtctctgtagaactcaggactaggggttcctg

SEQ ID NO: 46665 - DNA, 201 bp, Homo sapiens
atctcagataaatcgcatgagtctgcatgaggtccctcctctacctgggctctgagtagaaaggtacccttagagtctgggagtgcagtggagtccaggaggccttggagagaagcagcgtgggttgggtgcctgggtgccagggtgccagtggcagggtgggctgaccccgcccttaccatccctaggggccatgccact

SEQ ID NO: 46666 - DNA, 201 bp, Homo sapiens
gtccttctagcatttctagtccaccctgccccctccttctcacattcccctggaggggctggaggcgctgtccttactgacctgcctccctttcccacagrctgatggacctggccaaggaaatgaccaaagaggccctgccaatcaaatgcctggaagccgtgatcctgggaatgtatccttcctcacctgaaggggagg

SEQ ID NO: 46667 - DNA, 201 bp, Homo sapiens
ccacggggcaggggaccactggctcggtaagatctttaaaatgcagtgatatcatacctgtctaggagaactttctctcactgccattctaggagggaggrtcacatacattgtctccaggaggccctccccgctgtcttttaaaatgtccacgttttacaggaggggacagcagcagatggaactaacaaacacagtagg

SEQ ID NO: 46668 - DNA, 201 bp, Homo sapiens
ctcccccgccccagcagaggcgatgtgaggattgagaggactggggagcttctcaggggactggggtgctgggaccttgcttagtggtcgatattgttcargtggtcccctggggtgggcagaccaggacggctgcggagggaggaggtgggtgggctgggtttggatggtggtaggtgttgggcacatggcaaggtcact

SEQ ID NO: 46669 - DNA, 201 bp, Homo sapiens
ggctgcagccaaccctgcgttagagaggggctgctctcttctgcccctgagctgccgctccccacctagctctgggtcccccagcaccctggctcttgctsctcagtttgctattgtgtctttaaggcatcagattggatctagggtgagagccaacagttccctagtgtttagagctgtgatggattcccagcctattca

SEQ ID NO: 46670 - DNA, 201 bp, Homo sapiens
acttccatcgctagggtagaaggaattttgtgagaggtttggaaaaatttgaacctccccctcttcaaaccacagatctcagataaatcgcatgagtctgyatgaggtccctcctctacctgggctctgagtagaaaggtacccttagagtctgggagtgcagtggagtccaggaggccttggagagaagcagcgtgggtt

SEQ ID NO: 46671 - DNA, 201 bp, Homo sapiens
gtgatggattcccagcctattcagtgctaaacactcacctgtgttacttgcccctctccagcactcctgcgttttgaaaactcaagtcaagctgacggtgscatataaaggatgactcttttgtttttctcatttttttcttaagcagagctaaagctaccagtctgacttctcaatggctggagatacccagcatcaccc

SEQ ID NO: 46672 - DNA, 201 bp, Homo sapiens
cgcaacggatccgtggggccacagacctgcccaaggtgagacacacgggtcaggggggtgatagcacagtctaggttttagtgaccttggggccaagagtyaagccacactctcctcccacggggcaggggaccactggctcggtaagatctttaaaatgcagtgatatcatacctgtctaggagaactttctctcactgc

SEQ ID NO: 46673 - DNA, 201 bp, Homo sapiens
gttctacttccccagagaaaccaaactctgctagcccactagtctgagcatgggttatgtgagagaaaaggtagaaaggatggggcccctgcaaggcagtragccacccaggaatgtcatgggggagggcgtgaatattagatggctttgaacataactttgccccccacccaagagtctggtttttgtctgtatccaggt

SEQ ID NO: 46674 - DNA, 201 bp, Homo sapiens
gctgcttgaggagtaatgggttacctacagcagagacgagatggctgtttgtcaggaggcggtagaaaggtagaaaggattcagattgtggaagggtaaayggatgagatgaccattaaggttttgttttactgagaggctgtaagtctgccagggacagctgtcagtaaggctgcagaagggctggggggctacacaagg

SEQ ID NO: 46675 - DNA, 201 bp, Homo sapiens
gatgaggccagagtcacaccctgctcccacgtgaacaagtcgggcagctctccagccatcttgcttatgtctaaatcaggccataaaagagtgtgaatggytccctgcagaactgccaccactcctgggaactaaaaaagaaatagtgagctcactagtaactggtctgtaatgtcattctgtcatcttcagtcctcatgt

SEQ ID NO: 46676 - DNA, 201 bp, Homo sapiens
gaatgtggcggggaagccaccaggcagccgctgctggctccccaactccatctccctaacagaccactcactctcctcccgctctgctctcttcctcccayaggccctcgggtgacaagaagacttccgagcccaaagccatgccagaccttaacgggtaccagatccgggtctgaggcggatgccagcaccccaggcccc

SEQ ID NO: 46677 - DNA, 201 bp, Homo sapiens
  misc_feature (1)...(201): n = A,T,C or G, or insertion/deletion polymorphism (see Tables 1-2)
atgaaggaagtctaggggtgggggctgtgttgtgacagacccctagacttccatcgctagggtagaaggaattttgtgagaggtttggaaaaatttgaacntccccctcttcaaaccacagatctcagataaatcgcatgagtctgcatgaggtccctcctctacctgggctctgagtagaaaggtacccttagagtctgg

SEQ ID NO: 46678 - DNA, 201 bp, Homo sapiens
tggagagaatgttgcatctctcacttcccatcccgccaccccgtgtgtagccccctgcctggattcacttcccctggaaagtttctgcccatgaagccccragggcagaggagagtgaagagtgaatgccacagctgggtctaggggctctgcccaaagatgcccacagacttaagacccctgggctttaaaaattcatgt

SEQ ID NO: 46679 - DNA, 201 bp, Homo sapiens
ccaggtattttcttgaccttccttctcccagagcagccagctcctaggtcctttgtctgcacagcaggtgctagtgctttcgtgggtactgcctggtcccrgcccaggcctggctctgggtgaatgatccagtcctgggactgcagctccctttttgcagcttcttgtgggagggtgtactacaatctttatcccaagctc

SEQ ID NO: 46680 - DNA, 201 bp, Homo sapiens
aggacgagggagtgaggcaggggagggaaggcttctcttccgtccttgggccactgggctctggaaagccctgcagtgtggcaccagccctgctggacttyagagcggtggccacaaatccctggaagccccgtgcctattcgaggttccctttattgagctccagctggataccaggctcaatgctagatggcaggaata

SEQ ID NO: 46681 - DNA, 201 bp, Homo sapiens
gcccctgcaccctgccccagagctgtgtgtcctgggtcctctctcccaggcttctggctgcagaggtcagagatgggagagctaggcatgggtcctgggtsgggagaagccaggctgatgactgcatatcgggtccagctcctccttctgccagtggggaaaccggtccagtgaggcaggtggctggctcaggagcaatta

SEQ ID NO: 46682 - DNA, 201 bp, Homo sapiens
  misc_feature (1)...(201): n = A,T,C or G, or insertion/deletion polymorphism (see Tables 1-2)
gcagggttgcatgtggatatggggagaggacagggtgagggtaagagaagagtgaagccgcgtctgtggcctgtgtgtgtgccaaggtgcgggatggaggncgagggagtgaggcaggggagggaaggcttctcttccgtccttgggccactgggctctggaaagccctgcagtgtggcaccagccctgctggactttaga

SEQ ID NO: 46683 - DNA, 201 bp, Homo sapiens
ttccaggcagagctggagaggtatcagcagagccgcctcattccacaacgccagggccaccattcacgtgacatctctgtgctccctggtgctgtgggackcggcgcgtgtgcctcctgggtgtcggaggaattttgtctgatgagtgcagggcccactctgcactctctgccacccccttcccgctcctgccgtgtgatg

SEQ ID NO: 46684 - DNA, 201 bp, Homo sapiens
tggctggctcaggagcaattaaaggctgagttggaccccctaccctagcctcctctcagttcctgtggcttctcagctggttggaagatgaagtgctgtarggcgctgttcccagccacagcctctttctggccctcgccgaactggtcgcctgctccatgtctcttgtcctaagaagagaagccaggggagaacaaggga

SEQ ID NO: 46685 - DNA, 201 bp, Homo sapiens
  misc_feature (1)...(201): n = A,T,C or G, or insertion/deletion polymorphism (see Tables 1-2)
tggtgagagtgccgtggaggaggtggacggtggcgcaggctcagcttcagtcctgagcagcagccaactttggcaggcaggggaaaaggccggtgtgaganactcaggtgggaggccccgggggctggagaggtgagcaggtggggcagaggtgtaggaagtgggagtgggcctggggctggctgggggcacctcccaggc

SEQ ID NO: 46686 - DNA, 201 bp, Homo sapiens
cagttcaagttggtgctctggaaggcatggcgaatatgcccatgatactgggtgggtcccctaccaaggatgctcacccccctcaggaccactcccaaagcctagggcaccacctgagaagatgggaccccggatataccagctttgatccggcgcttgaaccagagcaaacttcaaacctaaaataaccccaatattata

SEQ ID NO: 46687 - DNA, 201 bp, Homo sapiens
  misc_feature (1)...(201): n = A,T,C or G, or insertion/deletion polymorphism (see Tables 1-2)
gaggtaacttcaggatcctagaattttctccagttcttctcctttttttccctggcagtaggatggttggccagcaggggaagagctgggctcccctgggnccagattcctctgtgtccctgctctgggccctctagcccctgcaccctgcccctgcaccctgccccagagctgtgtgtcctgggtcctctctcccaggct

SEQ ID NO: 46688 - DNA, 201 bp, Homo sapiens
  misc_feature (1)...(201): n = A,T,C or G, or insertion/deletion polymorphism (see Tables 1-2)
gaccggagctctttctctgtccccagatccccataccgagtgtgcctacgttccagccgtctacacctgtccctgagcgcctggaagctgtgcagcgctanatcagagagctgcagtatcctctctggtcaagggtcatggccaccttctggccggtgtggtgggccttgtttccaggcagagctggagaggtatcagcag

SEQ ID NO: 46689 - DNA, 201 bp, Homo sapiens
aaggatgtggaaacacgtggccaagatccaccccgatggagagaaggtggcgcaacggatccgtggggccacagacctgcccaaggtgagacacacgggtmaggggggtgatagcacagtctaggttttagtgaccttggggccaagagtgaagccacactctcctcccacggggcaggggaccactggctcggtaagatc

SEQ ID NO: 46690 - DNA, 201 bp, Homo sapiens
ccaggggagaacaagggagaaagccaaggagggtgagggagagggaaagagaaggaggcgtgaggcggggagaagaattcatgctgtgcccccatctcccytccaggagacttggctcttgagcttcaggataggcaggaagagagggtcaacctccttcaggccaagctaggaagcccttaacccgtgcccacaggtaca

SEQ ID NO: 46691 - DNA, 201 bp, Homo sapiens
tctgccacccccttcccgctcctgccgtgtgatggggtaaagagaggaaaatgggtcctgagtgacttgctggtggggtggccaagtctagatagatctcmtgctctgttgtccacccagccctagcagagggggagagagggagctgccttggggcttttaaaagtctgattttgaataaagggaaaaatggcagagaaa

SEQ ID NO: 46692 - DNA, 201 bp, Homo sapiens
ggcgctgttcccagccacagcctctttctggccctcgccgaactggtcgcctgctccatgtctcttgtcctaagaagagaagccaggggagaacaagggakaaagccaaggagggtgagggagagggaaagagaaggaggcgtgaggcggggagaagaattcatgctgtgcccccatctcccctccaggagacttggctct

SEQ ID NO: 46693 - DNA, 201 bp, Homo sapiens
  misc_feature (1)...(201): n = A,T,C or G, or insertion/deletion polymorphism (see Tables 1-2)
ccctttcccacaggctgatggacctggccaaggaaatgaccaaagaggccctgccaatcaaatgcctggaagccgtgatcctgggaatgtatccttcctcncctgaaggggaggggtccgggcttctctgggcctcagcttcctgctctgaaagtgagggtggggtaggttgaatgggctccagggctctcccatatgcag

SEQ ID NO: 46694 - DNA, 201 bp, Homo sapiens
cttggcacaggccacatctgccccaagagcatgagctcgtggctcaggagagccttcaggcccttgaggcccccatgggcagtgctgtgtgggcagaggargggtgatatgagagcgagcccagggaaggacctctgggcaaaaagttcccaggccctaactgcgtctacttgctcagtcccagctctgcctgttgctcta

SEQ ID NO: 46695 - DNA, 201 bp, Homo sapiens
ctccagacctcaggtaatccacccacctcagcctcccaaagtgctgggattacaggcgtgaaccaccacgcccggccagacatccatcacctttacttatrtgctttatcaagcggcaagactgggttttgctcagatcatttgtcccgatgaggccagagtcacaccctgctcccacgtgaacaagtcgggcagctctcc

SEQ ID NO: 46696 - DNA, 201 bp, Homo sapiens
gccaggtgccagccgtcctcccgctgagacgcgcccgagtggggacccgctgggcctcggggctcgcagccttcgcctccccgccgcgcccgctccctttmtggggactccgccgctgtttctggggacgaggggacaggggacccagacaaagcccactttgtgcagggagttggccgcaggcggggaatgtgcgcgtcg

SEQ ID NO: 46697 - DNA, 201 bp, Homo sapiens
ctcagccgagtacagctgcctcaaggccatagtcctgttcacctcaggtaggaaggagccctgtcttctcgtgcccacgggctcctagcccagagctgggscccagagaacttgggagtccccagggcaaacccagtctgctccttgaaaggccaaactgttgagtgcaacttaaagtgggaactttttatagctgctggg

SEQ ID NO: 46698 - DNA, 201 bp, Homo sapiens
ctagagatataaaaccatcattgactgcattatgcaatctaattagtttgcatgtagtttaacctgtgtgagtaatagagctgatactaattaacttgagrcaaaatgatttttgaaggtgtctggctttccattttgggccacacctgagctttttggctgcctccaggctgagttcagcatagcccaggtggatggaaa

SEQ ID NO: 46699 - DNA, 201 bp, Homo sapiens
tgtcctggggagaggagaggaaggctggattgcaggaaggatgcttcagatagattccccacatgggccatagggcagcctctgctgcctgtttcccccayctgcagtatccagattgggatgccctctcctgctccctttcctgagcccaggccccccgggcctgctgggccccagggaatctcctcaagccctcggttt

SEQ ID NO: 46700 - DNA, 201 bp, Homo sapiens
aagtctcagtgtgctttggaagaatacgttaggagccagtaccccaaccagccgacgagattcggaaagcttttgcttcgcctcccttccctccgcaccgkctcctcctcagtcatagagcaattgtttttcgtccgtttggtaggtaaaacccccatcgaaaccctcatccgggatatgttactgtccggcagcagtttt

SEQ ID NO: 46701 - DNA, 201 bp, Homo sapiens
ttctatgacctagaagcatagtcggtgaagtctttgtctgtgtacattgacaaatgtgcatctgatacatgtgcgcttacatgtgtgtacagagggtgtgmacaggggaggctgggcggctgcctcctcctgtccatcagtgggcagaggtctttcccctctcaccatgactgggtgtgtggcaggatgttggctggagag

SEQ ID NO: 46702 - DNA, 201 bp, Homo sapiens
ttggggcagtttgacagagctctgtgcacacacctcatgtgacccaattcaaacctcttaatctgatgactgaattcttcttcttcttcttcttcttcttyttcttcttcttcttcttctgtttttaaactttcttccagatgcctgtggtctctctgatgtagcccatgtggaaagcttgcaggaaaagtctcagtgtgc

SEQ ID NO: 46703 - DNA, 201 bp, Homo sapiens
aaaacaacaataatatattgattttatcttctcagagctttttaaccttagacgcacagcaagtgagcatctctggagaagacatttaaaaatatttttgyccttttttcttctcagtctgtagtcttgtctcttcttctatgcattaaaattaagtataattcatacggtgattttttttctcccttgtaacagcatttc

SEQ ID NO: 46704 - DNA, 201 bp, Homo sapiens
atttgggcaattaaaatgtcaggccacatacctgtgaaatgttaaccctacaaggaataaacagaaacagaacggcctttatcctctgaaaagaatatatrtcatatatatatgtcaccaaaccgaacaagtgatcagagttaattaagagaagggtttgccatcacccggatctggccaactctttcgtttggaaaatgc

SEQ ID NO: 46705 - DNA, 201 bp, Homo sapiens
gtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcattttt

SEQ ID NO: 46706 - DNA, 201 bp, Homo sapiens
ccctttcctgagcccaggccccccgggcctgctgggccccagggaatctcctcaagccctcggttttctctagcgccctggctgggcctccaggagatgcyctgggcagtggagcagccctgacattgtctctgcagggaaaagtttgcctgctaactcaataggagttggagctccaggcaaatccaacctgagggcagc

SEQ ID NO: 46707 - DNA, 201 bp, Homo sapiens
ctatgaagttgttctttttgcagtgacttcttgaggtagaatatggcttgggtttggttcttgtgacctgtactagtattatttcccatttggggcagaayctctgggtgcgttttaatgactatatgaatgcttaaaaggaacttgaggaacaatgaagtccgtactcaactgttctatgacctagaagcatagtcggtg

SEQ ID NO: 46708 - DNA, 201 bp, Homo sapiens
gttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttga

SEQ ID NO: 46709 - DNA, 201 bp, Homo sapiens
cggttttctctagcgccctggctgggcctccaggagatgccctgggcagtggagcagccctgacattgtctctgcagggaaaagtttgcctgctaactcartaggagttggagctccaggcaaatccaacctgagggcagcaattttcaaaatcatattcttactggaataatgcagactgccaggagaggcgaaaagatg

SEQ ID NO: 46710 - DNA, 201 bp, Homo sapiens
ttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaa

SEQ ID NO: 46711 - DNA, 201 bp, Homo sapiens
agccctgacattgtctctgcagggaaaagtttgcctgctaactcaataggagttggagctccaggcaaatccaacctgagggcagcaattttcaaaatcayattcttactggaataatgcagactgccaggagaggcgaaaagatgtgtcaggatggggcaacaggaggaaagggaccgtcataactcttcagaatgtctg

SEQ ID NO: 46712 - DNA, 201 bp, Homo sapiens
ttttcaaaatcatattcttactggaataatgcagactgccaggagaggcgaaaagatgtgtcaggatggggcaacaggaggaaagggaccgtcataactcytcagaatgtctgcaggaggttgaagactctggcctcttgcttcccctgcccaagcaaacacttaaggcaattttcaaacaacccaaagtgtatgccaact

SEQ ID NO: 46713 - DNA, 201 bp, Homo sapiens
aggctcgcactaagtatcagaatttactgttcgctttgcctctgcgcttcattttgcaaccttgtgcaactgacagccaggcaggcagggagggagaaaakcctagcccggcgccctcggccacggttcgggtaggcgagcgctcggttaagctaggaggagaatcgcgacgagaagggtactcaccatcgggcggggcgg

SEQ ID NO: 46714 - DNA, 201 bp, Homo sapiens
tgtaaatttttcagaggacctaactctgacagcccctggtgattttcaaagtaccacaagccagtggttaaaaattgcattgacttggaagttcagagggrcacaatggaagcccctttccctattcatggagctccagtgtggtggaagagaaaaacacacacggactagattgagggaaaggaggaattcaatgaatcc

SEQ ID NO: 46715 - DNA, 201 bp, Homo sapiens
cgggttggggcgagccaacgccggggtttctttgtgtttctgcgagagcgactctcccggtccggagtcagataacagcctgggcccgagcctcgccggcwttccccggcccttacaggccctgcccaggctccgctagtgccggccgcctgctccctgcctctcccggcttcctctctctttagccggcctctctctctc

SEQ ID NO: 46716 - DNA, 201 bp, Homo sapiens
catttcagaaaaaatatttctctcatatatacatatatacatatagatagatagatgggtaggtgtatgggaaagtggatggatggatggatggatggatagatggatggatggatggatggatggatggatgggtaggtgggtaggtgggtgggtaggcagatggatagacagataaatgcatagatgggcaatgcccag

SEQ ID NO: 46717 - DNA, 201 bp, Homo sapiens
gactgtcctcagaatgttagactaaaatgtgtgatctttattctcttcttttagtttaagatatgatctcatcttgtctcaggctggagtgaagtggctcratcatggctcacttgcagccttgaactccaggctcaagcgattctcctgcctcagtctccccagtggctgggactatagtcacgcgccatcgtgcggggc

SEQ ID NO: 46718 - DNA, 201 bp, Homo sapiens
atttcagaaaaaatatttctctcatatatacatatatacatatagatagatagatgggtaggtgtatgggaaagtggatggatggatggatggatggatagatggatggatggatggatggatggatggatgggtaggtgggtaggtgggtgggtaggcagatggatagacagataaatgcatagatgggcaatgcccagt

SEQ ID NO: 46719 - DNA, 201 bp, Homo sapiens
ttcagaaaaaatatttctctcatatatacatatatacatatagatagatagatgggtaggtgtatgggaaagtggatggatggatggatggatggatagatggatggatggatggatggatggatggatgggtaggtgggtaggtgggtgggtaggcagatggatagacagataaatgcatagatgggcaatgcccagtct

SEQ ID NO: 46720 - DNA, 201 bp, Homo sapiens
cttgtagtctgagctgctcaggaggctgaggtgagaggattgcttgagcccagaaggcagaagtttcagtgagccatgatctcaccactgcactccagccygggtgatggaatgagaccctgtctcagaaggaaaaaaaaaggacataaaagacttgacagctaaatgcaacatgtgaccctgaattggatccttgattag

SEQ ID NO: 46721 - DNA, 201 bp, Homo sapiens
tcagaaaaaatatttctctcatatatacatatatacatatagatagatagatgggtaggtgtatgggaaagtggatggatggatggatggatggatagatggatggatggatggatggatggatggatgggtaggtgggtaggtgggtgggtaggcagatggatagacagataaatgcatagatgggcaatgcccagtcta

SEQ ID NO: 46722 - DNA, 201 bp, Homo sapiens
ctgaggcaggagaatagcttgaaccagggagctggacgttgcagtgagccgagattgcatcactgcactccagcctggcgatggggccagactccgtctcraaaaaaaaaaaaaaaaaaaagggctatttgggcagacatgggaaggaaaggctggagatgttttgggcaaacttagatgcttcttaattctaggatgagc

SEQ ID NO: 46723 - DNA, 201 bp, Homo sapiens
  misc_feature (1)...(201): n = A,T,C or G, or insertion/deletion polymorphism (see Tables 1-2)
gcctgcctatcctgtctgcctccacatctgcctccatcttctcctttgtgaactcctcaggggcaggaaccaatgtcctgctcatttttgtgtgtggcccngcatctagcacagcaacagcaaatgcctgttaactgaattagagaaagtacatgtcttgaaaagcctaaaagcaatatccaggcaggactaagaaaacaa

SEQ ID NO: 46724 - DNA, 201 bp, Homo sapiens
  misc_feature (1)...(201): n = A,T,C or G, or insertion/deletion polymorphism (see Tables 1-2)
ggaaaaaatgaagtattttctatatgtgatgtttagaaatctggaattgagtcaacagcattcttaccattggctctccctgattttgtggtcaccgatgngtcaggtgggactggctcaggcagctcctgggtcttggtgctctgtgacctccctggctgagcttggattttcttccttcagggttcctagtgtgtctcc

SEQ ID NO: 46725 - DNA, 201 bp, Homo sapiens
aagtaggttctcaaacctgaaatacagttgctttctgctttttattttctgagttggtatttttctagggtgatttttccatctcagacctggagagtctsgtcccttcttaggccccagcgatggctcccagggtttcagaacagaaagctcaaaatggcctcccaaaacagaaagctcatgaggcttgcacgaccagct

SEQ ID NO: 46726 - DNA, 201 bp, Homo sapiens
tgcagtgagcctagatcgtgccactgcactccagcctgggcaacagagcgagaccatgtctcaaataataaaataaataaataaataaataaaacaaaatwagagggagtgttaaaccaaatctgagattttgaactcttttttaggaatgggggattgatccctttcattttaaaaagaaatggctcaggcttagtggtt

SEQ ID NO: 46727 - DNA, 201 bp, Homo sapiens
ccgaggtgggaggagcacttgaggccaagagttcggggctgcagtgagctatgatcacaccactgtgcctaggtgacagaacaagaccttgtctcaaaaamacaaaaacaaaaacaaaacaattaaaaattagctgggcgtgatggcatgcacctgtagtcctagctattcagaaggctgacgcaggaggatcggttaagc

SEQ ID NO: 46728 - DNA, 201 bp, Homo sapiens
gagactggaggatcacctgagcccagagagattgaggctacagtgaaccatgattgcaccacttcactccagcctgggagacagagtgagaccctgtctcaaaaaaaaaacaaaaaaacaaaaaacccttattcataacaagacaaattgtatatgtatgcagtaactctaaaaacagaaactagaaggatatgccaagtg

SEQ ID NO: 46729 - DNA, 201 bp, Homo sapiens
gaggccgaggcgggcagatcacggggtcaggagatcgagaccatcctggctaacatggtgaaaccctgtttctactaaaaatacaaaaaaattagccaggyggcgtggtgggcatctgtagtcccagctacttgggaggctgaggcaggagaatgatgtgaacccgggaggcagagcttgcagtgagccgagattgcgcca

SEQ ID NO: 46730 - DNA, 201 bp, Homo sapiens
gagttcaagaccagcctggtcaacatggtgaaaccccgtctctactaaaaatacaaaaattagctggtgtggtggcacgtacctgtaattccagctactcrggaggctgaggcaggagaatagcttgaaccagggagctggacgttgcagtgagccgagattgcatcactgcactccagcctggcgatggggccagactcc

SEQ ID NO: 46731 - DNA, 201 bp, Homo sapiens
gctagaatgcagtggtgcagtctcggcacctgtaacctccacctcctgggttcaagtgattctcctgcctcagcctcctgagtatctgggattacaggggyggctcaccacacctgcctaatttttgtatttttggtagagacggggtttcaccatgttgaccaggctggtctcaaactcctgaccacaagtgatctgcct

SEQ ID NO: 46732 - DNA, 201 bp, Homo sapiens
ggactttttttttttgggacggactctcactctgttgcgcaggctagaatgcagtggtgcagtctcggcacctgtaacctccacctcctgggttcaagtgrttctcctgcctcagcctcctgagtatctgggattacaggggcggctcaccacacctgcctaatttttgtatttttggtagagacggggtttcaccatgtt

SEQ ID NO: 46733 - DNA, 201 bp, Homo sapiens
gccccatgcctctcccatgggccagggagtatcacaggcttccacaacgaagtcaggatcctcccagaccctcagacactctcctctcggcccacccccartatttgtgggcccaggatggaaatacaaatggaggccactgactgtctccagatatttaaaagttacttgttgagccaacaaactgttagtaaaatgtgt

SEQ ID NO: 46734 - DNA, 201 bp, Homo sapiens
caggccccatgcctctcccatgggccagggagtatcacaggcttccacaacgaagtcaggatcctcccagaccctcagacactctcctctcggcccacccmcaatatttgtgggcccaggatggaaatacaaatggaggccactgactgtctccagatatttaaaagttacttgttgagccaacaaactgttagtaaaatg

SEQ ID NO: 46735 - DNA, 201 bp, Homo sapiens
ggagcctctccaggctcccgaccaagacccatcctgtctgggctgtcgtctccctctccttcattgcgcgggtgccgcccagccctcccctgtcgagttcycgtggtctccgttagatgttctccgtgcgatgactgactcctgttttggttctcctgtgtggaggagtctgacatcctgtgcctccagccagccaccctg

SEQ ID NO: 46736 - DNA, 201 bp, Homo sapiens
  misc_feature (1)...(201): n = A,T,C or G, or insertion/deletion polymorphism (see Tables 1-2)
cgctctggagcagtggggtcacacagactccagggagctccctgcaccagtctcagggcctgcaggggttgaggggctcccctggggctgggatcacaggngtgtgtggtgagaatgtggacccctggggatctctcaccctttcccgacacaggggagcctctccaggctcccgaccaagacccatcctgtctgggctgt

SEQ ID NO: 46737 - DNA, 201 bp, Homo sapiens
tcaccatgttggccaggatggtctccatctcttgacctcatgatccgccctcctcagcctcccaaagtgctgggattacagatgtgagccactgtgcctgrccgggtctttcttatatgatttgttaggtggggtgtggagcagtgcccagccagggctaattattccccagtacccaggccagacctttctgagtgctgc

SEQ ID NO: 46738 - DNA, 201 bp, Homo sapiens
gcgctccagggatgtggagatgcaggggctgctgggtcccagggcaggatgtagtctggtgggggctggactctcaaaatgatgccactgtgctgcagctrcctggaacctgggtcagtgtgggacccagcgtgagcccccgctctggagcagtggggtcacacagactccagggagctccctgcaccagtctcagggcct

SEQ ID NO: 46739 - DNA, 201 bp, Homo sapiens
ttcatccaggagacgtaagcagagacctgggtgaagactgtgggtttcctggagacatcacagccctggcttgttttccattattgcatcctgagggttcrttatatagtatcaatacaagtcttttatcaaatatgtgatttgcaagtcttttctctctatctatggcttgtcttttcattctcttaaacagtgcctttc

SEQ ID NO: 46740 - DNA, 201 bp, Homo sapiens
ggagtctgcctggctccacccattcctcctccctgtgctgtgacctggaaattttcctaggcagcaagctgggacggtggtcttttgttttgttttactatttttttttttgagatggagacttgctctgttgcccaggttggagtgcagtagtgcaatgtaggctcatagtaacctccacctcccgggttcaaccgattc

SEQ ID NO: 46741 - DNA, 201 bp, Homo sapiens
tcggctcccttgctctcatgggcagcctcttcagtgcactgcaccacactcttctgggtatgcaggacactgtagggtagagtgctggggacccgctgctycactgggtccacctggtgcctcgccgctgcagccttccgggtgcatgtggggagatgtccgtggcgctccagggatgtggagatgcaggggctgctgggt

SEQ ID NO: 46742 - DNA, 201 bp, Homo sapiens
ctttgttgggaaactttttattaatgattcaatctcattatttgttaatggtctgttcaagttttctatttcttcctaattcaatcttggtagtgttgtcratgggccagttcaggttcttgacttcacaaaagaatttgagagctagtccaaagtaagagcaggtgaagaagtctattgcatagcagaagtcactctgag

SEQ ID NO: 46743 - DNA, 201 bp, Homo sapiens
aatggctcactgcagcctcgaactcccgggctcagtggatcctcctgcctcagcctcccaagtagctgggactacaggcaagcaccatggtgtctggctatttttttttttttgtattttttttttttgtttagagatgaggtcttgctatgttgcccagggtggtcttgaacttctgagctcaagtgatctgcctgactc

SEQ ID NO: 46744 - DNA, 201 bp, Homo sapiens
ctctgctgcgagcttcagagacctgcagagacattggaatgacttgcctgcggagaggagccactctctccagggcctcctctctgttgagagctgaatgmttgagctcatgggacaatctgtctccagagaggagctacccactcctctgagctcttctaacactaaataaaactcctcttcacccttcacttgtctgtg

SEQ ID NO: 46745 - DNA, 201 bp, Homo sapiens
gctaacagggtgaaaccccatctgtactaaaaatacaaaaaaaaaaattagccaggcgcggtggtgggcacctgtagtcccagctactcactaggctgagrcaggagaatggcgtgaacccacgaggcggagcttgcagtgagccgagattgtgccactgcactccagcctgggcgacagagcaagactctacctcaaaaa

SEQ ID NO: 46746 - DNA, 201 bp, Homo sapiens
  misc_feature (1)...(201): n = A,T,C or G, or insertion/deletion polymorphism (see Tables 1-2)
gcagcccacccagacagcgccagtcacagtttaccatgtaacacctggttcaggtcgagtgcagtggctcatgcctgtaatcacagccctttgggaggccnaggcaggaggatcacttgaggccagaagttcaagaccagcctggacaacatactgagaccccatctctacaaaaaatttaaaaattagctgggcttggtg

SEQ ID NO: 46747 - DNA, 201 bp, Homo sapiens
gcaagactctacctcaaaaaaaaaaaaaaaaaaagatatttatcagtgtcaagtgttaagtgactttttgtttgttttccccatgaatattctaatacagrccaaattggcagagtgagatgggaagaagatcttctttgccatcctttgaaacactggactatggggacgaagaggacattgaaactcagctgtcatcca

SEQ ID NO: 46748 - DNA, 201 bp, Homo sapiens
aggtgtggtggcgagtgcctgtaatcccagctactcaggaggctgaggcaggagaatcacttgaacccgggaggcagaggttgcagtaagccaagattgcrctactatactccatcctgggtgacagagtgagactctgtctcaaaataataataacaataataataacaacaggctgggctcagtggctcatgcctgtaa

SEQ ID NO: 46749 - DNA, 201 bp, Homo sapiens
ctgaggcaggaagatcatctgagcccagcagctggaggctgaggcaggaagatcatctgagcctggcagctggaggctgaggcaggaagatcgcttgagcycggcaggttgaggctgcagtgcagtttccaccactgcacttcagcctgggtgacagagtgagaccctgtctcaaaaaaaaaaaaaaaaaagactgggata

SEQ ID NO: 46750 - DNA, 201 bp, Homo sapiens
cagccaccaggagcgcctccaagaaggtgaggtccttccagtgaggactggtcatgcattgatgtcactattgtcattttacccttctatctctctcctgccgggggccccagttgaaaatgagagaagtcatgttttgcatttttgactggaatgtggctgtttataacctttccacgtcactaccctcaatgcatagat

SEQ ID NO: 46751 - DNA, 201 bp, Homo sapiens
agaggatctcttgagcatgggaggtcaagggtgcggtgagctgagattgcgccactacactccagcctgggtgacagagcaagaccctgtctcaaaaattaaaaaaaaaataacaaaagtaaaagaatgaaagtgtatgtcggctgctcccttctcagtcacgttcctgaaagttgcagctgttgtcagtgcattaacttc

SEQ ID NO: 46752 - DNA, 201 bp, Homo sapiens
gcttgcagtgagccgagattgcgccactgcactccagcctgggcaacagagcaagtctctgtctcaaaaaaaaaaaaaaaaaagaaaagaaaaagaaaaawgaaaaaagaaaccatttcaaagcctgctaacagagtcagttttttttgtttttttgttttgttttgttttgcaaatatgctactgattacaaaggagtat

SEQ ID NO: 46753 - DNA, 201 bp, Homo sapiens
gccaccaggagcgcctccaagaaggtgaggtccttccagtgaggactggtcatgcattgatgtcactattgtcattttacccttctatctctctcctgcckggggccccagttgaaaatgagagaagtcatgttttgcatttttgactggaatgtggctgtttataacctttccacgtcactaccctcaatgcatagattg

SEQ ID NO: 46754 - DNA, 201 bp, Homo sapiens
ccctcacatgcacccaccactcactgactcacccagagcaatttctttccagtcctgcaagctctattcatggttaagtgccctgtacaggtgtaccatttctctctctctctctctccctccctccctccctctctctctcgctctctctctctctctctctctctgaggcagagtctcgctctgtcacccaggggctgg

SEQ ID NO: 46755 - DNA, 201 bp, Homo sapiens
cactcactgactcacccagagcaatttctttccagtcctgcaagctctattcatggttaagtgccctgtacaggtgtaccatttctctctctctctctctccctccctccctccctctctctctcgctctctctctctctctctctctctgaggcagagtctcgctctgtcacccaggggctggaatagtgcagtggcacg

SEQ ID NO: 46756 - DNA, 201 bp, Homo sapiens
tctgtattttatatttagtaaaatctatccattttttctttacattttctgtaataattgtaaatttagtaagacccttcctactattagtattatataartacttaatgtatttccttctagggcttgtttttatttttgttttggccaaaaatattgctaccattttgagatatttgaatttaacctttttttttttcc

SEQ ID NO: 46757 - DNA, 201 bp, Homo sapiens
actcactgactcacccagagcaatttctttccagtcctgcaagctctattcatggttaagtgccctgtacaggtgtaccatttctctctctctctctctccctccctccctccctctctctctcgctctctctctctctctctctctctgaggcagagtctcgctctgtcacccaggggctggaatagtgcagtggcacga

SEQ ID NO: 46758 - DNA, 201 bp, Homo sapiens
tgaggcaggagaatagcttgaaccagggagctggacgttgcagtgagccgagattgcatcactgcactccagcctggcgatggggccagactccgtctcgraaaaaaaaaaaaaaaaaaagggctatttgggcagacatgggaaggaaaggctggagatgttttgggcaaacttagatgcttcttaattctaggatgagct

SEQ ID NO: 46759 - DNA, 201 bp, Homo sapiens
tctttccagtcctgcaagctctattcatggttaagtgccctgtacaggtgtaccatttctctctctctctctctccctccctccctccctctctctctcgytctctctctctctctctctctctgaggcagagtctcgctctgtcacccaggggctggaatagtgcagtggcacgatctcagctcactacaacctctgcct

SEQ ID NO: 46760 - DNA, 201 bp, Homo sapiens
cattgctttaaatagtgttagatttcattctggtgcacacttaagccactagagaattgttggattatttatttatttgtttactttcttttctgttttctttttttttttctttttgtagaaacagggtcttgttatgttgcccaggctggttttgaggtcctgggctcaagggatcctcccacctcagcctcccaaagt

SEQ ID NO: 46761 - DNA, 201 bp, Homo sapiens
gtaatcccagcactttgtaaggctgagatgggcaggtcacttgaggtcaggagttcaagaccagcctggccaacatagagaagccctggctacttaaaaawatatatatatgtatatatacagaaaattagctgcgtgtggtggcgcatgcctctaatcccaactactcaggaggctgaggcatgagaatcacttgaacct

SEQ ID NO: 46762 - DNA, 201 bp, Homo sapiens
tgaggcatgagaatcacttgaacctgagaggcggaggttacagtgagccatgatcatgccaccgcactccagcctgggtgacagagcaagactgtgtctcaaaaaaaaaaaaaaaaaaaatgaacctattcattgttagacatttgcaactcctcttattcacttgagttggggtcactaattatgcttggtttcaaatta

SEQ ID NO: 46763 - DNA, 201 bp, Homo sapiens
tgatccagacttgcaatcccagaccaaacttatccggggttgctagattttaaaggctctgacacacaaggagtgggtagggagcacagccaggaggcacygtccaccctggcctggcagcgtcccctcattcacagagtccttcccccgaccagggctacaagaagcaggcagcactgaagctgggggacatcagtcacc

SEQ ID NO: 46764 - DNA, 201 bp, Homo sapiens
ttttgtttctacattttactctgatctgaatgtaatattggtctcaagttttatttgctcctcatcttctttattcttttaaaaattcctcttgtttgaaytggacttccggaatcaatgcacacctctaattgcctttctctttttttctgctgccttccatctcactgatatttttattttgtctcattttctttttat

SEQ ID NO: 46765 - DNA, 201 bp, Homo sapiens
caagaagcaggcagcactgaagctgggggacatcagtcaccgtctgctggagcagcaggaggacttcgccggcaagacagcccagtaccggcaggagatgyggcacctgcaccaggtgctgaaggacaagcaggaggtgctggaccaggcgctgcagcagaacaggtggggcatgcgccctgcgccatggcccgcagagat

SEQ ID NO: 46766 - DNA, 201 bp, Homo sapiens
gaaaaatagaagcataagttcctactgacggaaactgctgaaaacttaccaggaaaagtgttgccgcaaaggagatcaaaactatactccaaagtgaaccyctaggtagctggctagagagctggagatagctggagagacaggacttcaggaggcagtcagagccaggaagaaatgtcacagagcagacacaggacctca

SEQ ID NO: 46767 - DNA, 201 bp, Homo sapiens
  misc_feature (1)...(201): n = A,T,C or G, or insertion/deletion polymorphism (see Tables 1-2)
tgagacaggatcttgctctgccacccaggctggaatacagtggtgtgatcatagctcactgcagcctctacctcctgggcttaaaccatcctcccatctcngcttcccgcagtgttgggattacaggcatgagccactacatccttatatgctcaaatatatctgaaaagaaccatacccagttgataaccatggttacct

SEQ ID NO: 46768 - DNA, 201 bp, Homo sapiens
atggccacacggtctgtaggatagacaagcccataaataattctgtacacaatggtaaaacaagaactgctgttgatgtgtgtaccagaagggcagtgacrtcagcctggagagttggcctgggcctggcagggagtaaggaaagaattctgggtgcagaagacagcaaataccaaggcctaaaaaagaatgaattatttg

SEQ ID NO: 46769 - DNA, 201 bp, Homo sapiens
ggtaatagaaatgaggagggtgaggactctggaaatctttttgagaaatgataaataagaacacaggacacaaagtagattcacagaaccaagtgaactgygtgtacattaaatgtacattaaatacaacatgaatttgggatgctgtaaattgtaagtttaatctttatgagactctttttctgaaaagttcatgactaa

SEQ ID NO: 46770 - DNA, 201 bp, Homo sapiens
aaatgattttgtgcagtatgtatgtagacacaaaatgttcacaccatttgactcaagaatttactgtatgggccggacacagtggctcacgcctgtaaccycagcactttttgaggctgaggcgggcgtatcacttgaggtcaggagttcaagaccagcctggccaatgtggtgaaaccccatgtctactaaaaatacaaa

SEQ ID NO: 46771 - DNA, 201 bp, Homo sapiens
  misc_feature (1)...(201): n = A,T,C or G, or insertion/deletion polymorphism (see Tables 1-2)
ttaaacatttgctcattggaaatttgttcagtgccagccgtgtgtcagagatgatagagccacaggcctttcccctcgcatcccagctgcagaggaggagntgcagattgcaaaccgtagtctggggtgctaaggtgggcagtagaggtggttgtctctcagttagggaaggtggtagggaaaggagggttcatcaagctg

SEQ ID NO: 46772 - DNA, 201 bp, Homo sapiens
  misc_feature (1)...(201): n = A,T,C or G, or insertion/deletion polymorphism (see Tables 1-2)
gaattatattatgattgaaaagcttgttttggagaatatccagattaattttatctgaaaataaagattacattttctttttcttgtattagttgttgaantttcacccttgcctcaaaagagagggtccaaacactaggtagtggacgtatgtccatacaggatgtgcttgggtcctgggagggtgggggttggacctgg

SEQ ID NO: 46773 - DNA, 201 bp, Homo sapiens
tttctttttcttgtattagttgttgaactttcacccttgcctcaaaagagagggtccaaacactaggtagtggacgtatgtccatacaggatgtgcttggrtcctgggagggtgggggttggacctggggggacgtggacctgtgggatatgctgggatcctgggggaagggaggtggacctgtgggatgtaatgggatcc

SEQ ID NO: 46774 - DNA, 201 bp, Homo sapiens
  misc_feature (1)...(201): n = A,T,C or G, or insertion/deletion polymorphism (see Tables 1-2)
gggatgtaatgggatcctgggggtggaaggaggacctgtgggatgtgctgggatcccagtgggaggagtggacccatgatgtactgggatccgtactgggnaggcaggtgcagttatgggctctgctctgaggctgaaggcagagggagaggtctagagatgctttatgggttatgccccctgaacagtttggggagcttc

SEQ ID NO: 46775 - DNA, 201 bp, Homo sapiens
ccggtccccagccttcaggccctctccgacctgaaggcggggcctcaccggggacctgcctgcttctgcccaggaacctgtctccctcctgctgcccagtmcatggcacccaggctgctcacaccaaggggcaactgcaggccagtgcagagccatcctcagcacccccttgtctttccctcctgtgctcatgggtgccca

SEQ ID NO: 46776 - DNA, 201 bp, Homo sapiens
ctgcactccagcctgggcaacagagtgagaccctgtctcacacagacacacacgtagtgtgtgcccagccacaccctctctccggtggtctagcagcttgrtcccaggtcctctagggcccaggatggggagatgtttccacagaggcattccaagtgacccacccaggggctggagggctgggctgttatcactcatctt

SEQ ID NO: 46777 - DNA, 201 bp, Homo sapiens
gtctggagggggctgaggcggcagggcgctgtcgtgtcagtactgccctgagtatgcacactcccagccaggctgtgacagtgcccaggcttggcctaaaycccgctccaaccctgctgcaagactggagcaggcaccaggagcagggagagaccaggcagctagagcaaacacccataagcctgcggggacacgggagcc

SEQ ID NO: 46778 - DNA, 201 bp, Homo sapiens
cagcctcccaaagtgctgggattacaggtgtgagccaccacgtccggctcaaaagatctttaaaaggtcatttttatcagctgactctcattagtatttcstaatagccaataattgtgttttgtgaggtcttctgtgccaagtttttatcctcctcttttgattttcagtttctaagctgactaaacaactaatgctcct

SEQ ID NO: 46779 - DNA, 201 bp, Homo sapiens
ggcaacagagtgagaccctgtctcacacagacacacacgtagtgtgtgcccagccacaccctctctccggtggtctagcagcttggtcccaggtcctctarggcccaggatggggagatgtttccacagaggcattccaagtgacccacccaggggctggagggctgggctgttatcactcatcttcctcgttatgtgact

SEQ ID NO: 46780 - DNA, 201 bp, Homo sapiens
atttttgtagagatgggctcttgctatgttgctcaggccggtctcgaactcctggcctcaagcaagcttcctgcctcagcttcccaaagtgctgggattgyaggtgcgagccaccaggcccagcctcatcagctctttctaggccactttgtgtctccactcctaccagggcaaggtgtatccctggagccacccctcccc

SEQ ID NO: 46781 - DNA, 201 bp, Homo sapiens
tggaagccgaacttgaacgagcacagaaaatcaataggtttgtgtctttttttcctttaagttgcttttattttcaatagttaaaaaagacaaatggtctrggtacagtggctcactcctgtaatcccagcactttgggaggctgaggcaggcgatcatttgaggtcagaagttcaagaccagcctggccaacatggcaaa

SEQ ID NO: 46782 - DNA, 201 bp, Homo sapiens
  misc_feature (1)...(201): n = A,T,C or G, or insertion/deletion polymorphism (see Tables 1-2)
gctacttgggaggctgaggcatgagaatagcttgaacccaggaggtggaggttgcagtgagccaagatcgtgccaccgcactccagcctgggtgacagacnagactgtctccaaaacaagcaaacaaacaaaaaccatttcttgtcgtgtagcaggtggtggaggggggcagggtggaaacatggaaactgtggaatcact

SEQ ID NO: 46783 - DNA, 201 bp, Homo sapiens
aagcactgggattttagatatgagccactatcatggccaagttgcccactttacaatgagacacttgacttctttttattgatttgcaggaactccttacrtatgaaagattttatccctttgtcataggtgtaatattttcttagtttgttgataattgggctaaatcaataaaatgtttttcttttatgacttacactc

SEQ ID NO: 46784 - DNA, 201 bp, Homo sapiens
tatccggggttgctagattttaaaggctctgacacacaaggagtgggtagggagcacagccaggaggcactgtccaccctggcctggcagcgtcccctcaytcacagagtccttcccccgaccagggctacaagaagcaggcagcactgaagctgggggacatcagtcaccgtctgctggagcagcaggaggacttcgccg

SEQ ID NO: 46785 - DNA, 201 bp, Homo sapiens
ctaaacaactaatgctcctggaggcaaaaacccacggccaggaaaaggagctggcggagaacagggaacagctggagattttacgtgccaaatgccaagawctcaaaacacactcggatggcaaaatcgcagtggaagttcataaatcaattgtgaatgaattaaaaaggtaaggatttaatgttttttcttttttttttt

SEQ ID NO: 46786 - DNA, 201 bp, Homo sapiens
gaggcatgagaatcacttgaacctgagaggcggaggttacagtgagccatgatcatgccaccgcactccagcctgggtgacagagcaagactgtgtctcaaaaaaaaaaaaaaaaaaaatgaacctattcattgttagacatttgcaactcctcttattcacttgagttggggtcactaattatgcttggtttcaaattaa

SEQ ID NO: 46787 - DNA, 201 bp, Homo sapiens
aggcatgagaatcacttgaacctgagaggcggaggttacagtgagccatgatcatgccaccgcactccagcctgggtgacagagcaagactgtgtctcaaaaaaaaaaaaaaaaaaaatgaacctattcattgttagacatttgcaactcctcttattcacttgagttggggtcactaattatgcttggtttcaaattaaa

SEQ ID NO: 46788 - DNA, 201 bp, Homo sapiens
agttggggtcactaattatgcttggtttcaaattaaattcagttacctcttctcaccttgaaacttaatagaagatttaggttgctgaagaatagcatttmaatgctaacatacttgctgtttttgtaatacagatattcaccatgccctagccatgtaaactaatgggctttttattctaccatttggggtaactctcta

SEQ ID NO: 46789 - DNA, 201 bp, Homo sapiens
acatgcacatgtgggggtacatgtgatattttgtaatgtgcatagaatgtgtaacaattaagtcaggtatttgggctatccatcaccacaagcatttatcttttttttttttttttttttaagacggagtctcacgctgtcacccaggctggagtgcagtggcgtgatctcggctcactgcaacctccgcttcctgggttc

SEQ ID NO: 46790 - DNA, 201 bp, Homo sapiens
ggcagccggaggtgcgtaagcccactgaacgctgcagggcagggaagaaataaatggtctcatagtttaatccattgataacattttgctttattttttawttttttttttttttttagagctagggtctcactctgttgcccatgctggagtacagtggtgcaatcatagctcacggcagcctcaaacatgtttgagatc

SEQ ID NO: 46791 - DNA, 201 bp, Homo sapiens
gcagccggaggtgcgtaagcccactgaacgctgcagggcagggaagaaataaatggtctcatagtttaatccattgataacattttgctttattttttaattttttttttttttttagagctagggtctcactctgttgcccatgctggagtacagtggtgcaatcatagctcacggcagcctcaaacatgtttgagatcc

SEQ ID NO: 46792 - DNA, 201 bp, Homo sapiens
agtgaggtttttatccatttctgccttgtccaccgccgttttgtgggaatgacttcgcgcagcggagctcgttctaacttcaggaggccaagcctgtgtaggtgttgtagatgcctcctgtgcctcctgcattcctctgggttcctcatttaagtgtccatatagatccctgaaattggaaggatccagcgaaagaaatgt

SEQ ID NO: 46793 - DNA, 201 bp, Homo sapiens
gaatctacttcctgggtggcctgtcctcaaactttgtgcttgaataaactctctttaaactagagtctcacccttttgattattttaggttgacatcagcmtctgttattttttgtctttttaatgatagccattctaactggagtaagatgatatctcattgtggttttgatttgcatttctgtgatgatttgtggtgtt

SEQ ID NO: 46794 - DNA, 201 bp, Homo sapiens
  misc_feature (1)...(201): n = A,T,C or G, or insertion/deletion polymorphism (see Tables 1-2)
ggcctaaaaaagaatgaattatttgctgtttgggaaatggaagcccacgctgagtgctgaagcacagggactctgcgcaggaagaggaggggaagcaaganatgaatttgggtccttgtgatggcagtggctgctgccatcacgctgtgtggctagggctgcacacttcatggagccggtggaagccccgtccctcatgag

SEQ ID NO: 46795 - DNA, 201 bp, Homo sapiens
  misc_feature (1)...(201): n = A,T,C or G, or insertion/deletion polymorphism (see Tables 1-2)
ctgtggctgcccccccaggcacaggacgagggcatctctgtagcctgcaccatcggccatcccaggaaggacagcccccttcaccctccatccctgcaggntcaggggtgtctgcttccactgcctggcctctctccactccagcaactgctctgatcttggaggggagtcggagccaagacctgcagccatgaatggcag

SEQ ID NO: 46796 - DNA, 201 bp, Homo sapiens
tggcagccggaggtgcgtaagcccactgaacgctgcagggcagggaagaaataaatggtctcatagtttaatccattgataacattttgctttattttttwattttttttttttttttagagctagggtctcactctgttgcccatgctggagtacagtggtgcaatcatagctcacggcagcctcaaacatgtttgagat

SEQ ID NO: 46797 - DNA, 201 bp, Homo sapiens
cggtgtgatctcggctcactgcaacctctgcttcctggattcaagcgattctcctgcctcagcctcctgagtagctgggattacaggcacgtgccaccacrcctggctaatttttgtatttttagtagagatggggtttcaccatgttggccaggctggtctcgaacttctgacctcatgtgatctgcccaccttggcctc

SEQ ID NO: 46798 - DNA, 201 bp, Homo sapiens
ctactaaaattacaaaaattggccaagtgtggtggcatgcgcctataatcctagcactttgggaggctgaggtgggcagatcacttgaggtcaggagatcragaccagcctgaccaacatggtgaaacgccatctctactaaaaatacaaaaattagccaggtgtgttggcacatgcctgtagtcccagctgctcaggagg

SEQ ID NO: 46799 - DNA, 201 bp, Homo sapiens
agcctgaccaacatggtgaaacgccatctctactaaaaatacaaaaattagccaggtgtgttggcacatgcctgtagtcccagctgctcaggaggatgagrcaggagaatggcttgaacccaggaggtggaggttgcagtaagccaatatcacgccattgcactccagcctgggcgacaaagtgagaatccgtcaaaaaaa

SEQ ID NO: 46800 - DNA, 201 bp, Homo sapiens
atttaaaaaaattagctgagcatggtggcgcatgcctgtagccccagctactcaggaggctgaggcaagaggatctcttgagcatgggaggtcaagggtgyggtgagctgagattgcgccactacactccagcctgggtgacagagcaagaccctgtctcaaaaattaaaaaaaaaataacaaaagtaaaagaatgaaagt

SEQ ID NO: 46801 - DNA, 201 bp, Homo sapiens
aataaaaagtgaaatgaatgaaggaagggaggaaggaaggcgtgaacaaatgaatgaatgaacaaataaagaaaaagtcttataaattagtccaaaatgcrgctgggcatggtggctcacgcctgtaatcccagcactttgggaggccaaggcaggaggatcacctgaggtcaggagttcgagactaggctggccaacatg

SEQ ID NO: 46802 - DNA, 201 bp, Homo sapiens
gggtgcggtgagctgagattgcgccactacactccagcctgggtgacagagcaagaccctgtctcaaaaattaaaaaaaaaataacaaaagtaaaagaatgaaagtgtatgtcggctgctcccttctcagtcacgttcctgaaagttgcagctgttgtcagtgcattaacttcgaaaggaaagcagagttttcagttctaa

SEQ ID NO: 46803 - DNA, 201 bp, Homo sapiens
ttatgttcccaccaacagtatatgagtccagttgcttcatattctcaccaacacttggtttggtcagagtgtgtgtgtgtgtgtgtgtgtgtgtgtgtgtktgtgtgttcatgtgcatgcgtgtgagtgcgtgtgtgtgtgtgtgtgtgtgtgtgtggtcttttataacttggacagtcagtggttagttttcatccacat

SEQ ID NO: 46804 - DNA, 201 bp, Homo sapiens
  misc_feature (1)...(201): n = A,T,C or G, or insertion/deletion polymorphism (see Tables 1-2)
caggtccttactcttacagaacttggggctgtgaagatgtgagtgacactgtggacacaggagagggaggcaccgctggctgggctcttgctggggtaganggcgggaaggcacacggtgttctcccatggctcctgggagttcaggcctcatgggcttctgagttgctttttgaaggagggcttacgtttcacttttttt

SEQ ID NO: 46805 - DNA, 201 bp, Homo sapiens
tcactttcctccttcgacacatggggattacaatttgagaggagatttgggtaatggcacagagccaaaccatatcagtgtgtaaggtatagatccatgatttttttttttttttgcatatggaaatttgatttttccagcaccatttgatggtaaggctattagttatttattgctgtgtgacaattgcaccaaaatgta

SEQ ID NO: 46806 - DNA, 201 bp, Homo sapiens
acttttgttaaatcaagaaatgttggctgggcatggtggctcacacctgtaatcccagcactttgggaggctgaggtgggcggatcagttgaagtcaggcrtttgagaccagcctgaccaacatggtgaattcccatctatgctaaaaatacaaaaaaattagccaggcatggtcgtgcgcacctgtaatcccagctacct

SEQ ID NO: 46807 - DNA, 201 bp, Homo sapiens
atggtggtttttatcccacatctgattgatgctctttttttttttttttttttttgagatggagtctcgctctgtcgcccaggctggagggcagtggcgcratctcggctcactgcaagctccacctcccaggttcacgccattctcctgcctcagcctcccaagtagctgggactacagatacccgccaccacgcccacc

SEQ ID NO: 46808 - DNA, 201 bp, Homo sapiens
tcttccctgatcaccccagccagaagtgattgatctctctctctctttttttttttttagacacagtctctctatgtcgcccaggctggagtgcagcatgyacaatctcagctcactgcaatctctacctcccgggttcaagtgattcttgtttctcagcctcctgagtggctgggattccaggcgtgttccactgcgccc

SEQ ID NO: 46809 - DNA, 201 bp, Homo sapiens
ggtctttcttatatgatttgttaggtggggtgtggagcagtgcccagccagggctaattattccccagtacccaggccagacctttctgagtgctgcaccyggcatcttgtgaatgataggtttctccagtcttcctggtgggagcagctgccgtcttgggctgtatgtaagcacctggcactgctcctctgatcctggtg

SEQ ID NO: 46810 - DNA, 201 bp, Homo sapiens
aaaaaaaaaaagccaagtgtgctggctcacacttgcaatcccagcactgtgtgaagctgaggcaggaggatcacttcaggccaggagttcaagaccagcctgggcaacatggtgaaaccccatttctacaaaaaatacaaaaattagccaggtgtggtggcatgcacttgtagtctgagctgctcaggaggctgaggtgag

SEQ ID NO: 46811 - DNA, 201 bp, Homo sapiens
gtggagcagtgcccagccagggctaattattccccagtacccaggccagacctttctgagtgctgcacccggcatcttgtgaatgataggtttctccagtsttcctggtgggagcagctgccgtcttgggctgtatgtaagcacctggcactgctcctctgatcctggtgaatggttcttcctccactgtctggtaatttc

SEQ ID NO: 46812 - DNA, 201 bp, Homo sapiens
agggttggtgtctgcctttggagtggtgggaagacactggaggtctctaagggtgcatggggcagggatgggagtagggatccacgatcacatttgtctgttttttttttttttgttttgtttgttttgttttgttttgttttgagacagaatttcactcttgttgcccagactagagcacaatggcacaatcttggctca

SEQ ID NO: 46813 - DNA, 201 bp, Homo sapiens
gggttggtgtctgcctttggagtggtgggaagacactggaggtctctaagggtgcatggggcagggatgggagtagggatccacgatcacatttgtctgttttttttttttttgttttgtttgttttgttttgttttgttttgagacagaatttcactcttgttgcccagactagagcacaatggcacaatcttggctcac

SEQ ID NO: 46814 - DNA, 201 bp, Homo sapiens
tgtcctgctgctccccattcccagggcaccagctgcttcattccacactgagcgcttgcttcagaacccaggcaccgagggctctgttccctgctgatagygttcttctgttttgagttcttgctactttgggattcatatgggctctatattatttttaaaattgtgccattttaaacttatttccctcagagaaatgga

SEQ ID NO: 46815 - DNA, 201 bp, Homo sapiens
  misc_feature (1)...(201): n = A,T,C or G, or insertion/deletion polymorphism (see Tables 1-2)
cagggacaagtgggagccctgcctcttccaagttggcggggtgggagctcccaggtgcagctgtggctgcccccccaggcacaggacgagggcatctctgnagcctgcaccatcggccatcccaggaaggacagcccccttcaccctccatccctgcaggctcaggggtgtctgcttccactgcctggcctctctccactc

SEQ ID NO: 46816 - DNA, 201 bp, Homo sapiens
ctttggagtggtgggaagacactggaggtctctaagggtgcatggggcagggatgggagtagggatccacgatcacatttgtctgttttttttttttttgttttgtttgttttgttttgttttgttttgagacagaatttcactcttgttgcccagactagagcacaatggcacaatcttggctcactgcaaccaccgcct

SEQ ID NO: 46817 - DNA, 201 bp, Homo sapiens
cctgagcccagagagattgaggctacagtgaaccatgattgcaccacttcactccagcctgggagacagagtgagaccctgtctcaaaaaaaaaacaaaaraacaaaaaacccttattcataacaagacaaattgtatatgtatgcagtaactctaaaaacagaaactagaaggatatgccaagtgtacaaagagatggga

SEQ ID NO: 46818 - DNA, 201 bp, Homo sapiens
gtcctgctgctccccattcccagggcaccagctgcttcattccacactgagcgcttgcttcagaacccaggcaccgagggctctgttccctgctgatagcrttcttctgttttgagttcttgctactttgggattcatatgggctctatattatttttaaaattgtgccattttaaacttatttccctcagagaaatggaa

SEQ ID NO: 46819 - DNA, 201 bp, Homo sapiens
aattattaagtatttctgcagcgatggggtcttgctgtgttgcccaggttggtcttggactcctgttctcaagtgaccctcctgccttggcctaccaaagygatgggattatagtcatgagccaccatgcctggcccctggtctttcttccttaagccacagggaataaaagtgtttcatttcatctgggagggttttaag

SEQ ID NO: 46820 - DNA, 201 bp, Homo sapiens
agatgggacggtggaaaatttaatcttttagcttctgtgtactttgtagtatcccacatttatggtaaggacttggaggcagtgcatttaatacatgataytggccgggcacggtggctcacgcctgtaatcccagcactttgggaggccgaggcgggcggatcacgaggtcaggagatcgagaccaccgtggctaacagg

SEQ ID NO: 46821 - DNA, 201 bp, Homo sapiens
tctgctgttagtcccatccaatatattgttcactttgtgtaatgatttttcccatctctgtaagaaagatccatttgagtcttttttgtattctccgtctytgtccccagcatgctatttttctcttctttctcaaatgtaggagcatgtttttctaaaaacctttgtttgccaacgccatcatctctctcacttctgaat

SEQ ID NO: 46822 - DNA, 201 bp, Homo sapiens
tctttcctaggctttacgcagtttcctctcacacacggacagatcagtacccagccaaagacccttcaaggtctctagagccctttctcgctccgtgaaaygccctctgccctgccctggaaattccagctgccttgaccttcctgctcttggatctctggctcctgggctcagcaggtgtctgccagacaagaaggtgga

SEQ ID NO: 46823 - DNA, 201 bp, Homo sapiens
cacggacagatcagtacccagccaaagacccttcaaggtctctagagccctttctcgctccgtgaaacgccctctgccctgccctggaaattccagctgcmttgaccttcctgctcttggatctctggctcctgggctcagcaggtgtctgccagacaagaaggtggagggagcagttgcagcactcaccttgttttccct

SEQ ID NO: 46824 - DNA, 201 bp, Homo sapiens
tgtctgccagacaagaaggtggagggagcagttgcagcactcaccttgttttcccttccctttgggatcacagtcctgcctcgcctgttgtccaaagtccraaaactgttgtttcttctgttttgcctggttttttagctgaggagtaaatctggtctctgtaactctatcttggctgaaagcagaagtcttggtattttc

SEQ ID NO: 46825 - DNA, 201 bp, Homo sapiens
atataaagtatcacaaattctttatgaaggtatgtttttagtagacttatttattgatatataaaatatgcacaagaagtgagtaaatcataagtgcacakttcgatacattttcaaaaagtagccaccactcagattaaaaaaaaattacttgtaccctagaaatcacccttcttcttagtcactacttcccacagagtt

SEQ ID NO: 46826 - DNA, 201 bp, Homo sapiens
tctgtagtcccgtctactcgtgtggctgaagcgggagtttgaggctgcggtgagctatgatcgtaccactgcactccactctgggcaacagagcaagaccscatctcaaaaacaaaacaaagcgaaaaacaataaggatatcacttgcttctcaggaagtcgccctgctctgcagggggagccacatgagacatcactggg

SEQ ID NO: 46827 - DNA, 201 bp, Homo sapiens
atgcacaagaagtgagtaaatcataagtgcacatttcgatacattttcaaaaagtagccaccactcagattaaaaaaaaattacttgtaccctagaaatcmcccttcttcttagtcactacttcccacagagttaaccattgccaagattagctttaatctttaaaaataacctgagattagctttgcctgttctgaaaat

SEQ ID NO: 46828 - DNA, 201 bp, Homo sapiens
aggatgtttgggatgcgagatggggctggaggagtgggcagggaccaggctgggggtgcctttggtgtcctgtttagagggttggtgtctgcctttggagyggtgggaagacactggaggtctctaagggtgcatggggcagggatgggagtagggatccacgatcacatttgtctgttttttttttttttgttttgtttg

SEQ ID NO: 46829 - DNA, 201 bp, Homo sapiens
ggtcaaggggagagcttaggatgtacaggaatcatctaggaacagctcaagggctaggcatgatctttgtggggctgggatgagctttccagacagaaacragggagtgtgacacaggtggcagtggaaagaggatgtttgggatgcgagatggggctggaggagtgggcagggaccaggctgggggtgcctttggtgtcc

SEQ ID NO: 46830 - DNA, 201 bp, Homo sapiens
gtcaaggtaagtggttatttggcctcagagatttcattttcagatgggaatgcaggctcactgctgtggatttttgtgtttaagaaaatgacaccttttgyatgtgcatcactaatagtccacagagtaaaagtattgtaaggttttgctggcagaatagcacctctcacctcattcaataaactttggttcattcacaca

SEQ ID NO: 46831 - DNA, 201 bp, Homo sapiens
tccagttgcatggaatatttttttatccctttactttcagtctgtatggatctttacaagtgaaatgtgtttcttgtaggcagcacatagttgaatcgtgttttttttttctgatatccattcagccagtctgtatcttttaagtggaaaatttaattaatttacattcaaggttactattgatatgcgaggacttactcc

SEQ ID NO: 46832 - DNA, 201 bp, Homo sapiens
ctttgggaggccgaggcgggcggatcacgaggtcaggagatcgagaccaccgtggctaacagggtgaaaccccatctgtactaaaaatacaaaaaaaaaarttagccaggcgcggtggtgggcacctgtagtcccagctactcactaggctgaggcaggagaatggcgtgaacccacgaggcggagcttgcagtgagccga

SEQ ID NO: 46833 - DNA, 201 bp, Homo sapiens
tagataatgacatttctttaatggcaaaatatagcaccatatccctttttcctttatttttttctttcttttcatttcttttctttttcttttcttttttyttttttttttttttgagacagagtcttgctctgtcctccaggctggagtgcagtggcaccattatagctcactgtagcctcaacctcctggactcaagtg

SEQ ID NO: 46834 - DNA, 201 bp, Homo sapiens
aatgtgttattcatagtgtctgtacatatagaccagcagcattaagctacaccggtattgattatatgtatattaattagcccctactatattaaaacacttttttttttttaaattgagatggggtctcactgtccccaggctggagtgcagtggcacgatcctagctcattatagccacctcctcctgggctcaagtga

SEQ ID NO: 46835 - DNA, 201 bp, Homo sapiens
attgcttggctacaaagaaagcctcaataaatccctaaagtagaaataatgtaggcatttgttttttgtttgtttgtttttagacagagtctcactttgtygcccaggttggagtacagtggcgtgatcttggctcactgcaacctctgcctcccaggttcaagcaattctcctgcctcagcctccccagtagctagaatt

SEQ ID NO: 46836 - DNA, 201 bp, Homo sapiens
catagcaagcagctctggaataggcagacactgcccagagctcaatatggacaactgtgctcctgtcgagctctgcagggctcagaatcagtcccactgcycctcacccgcacacttgccggctggttattttgtaccgatgttacacatagagtcatatctctccactgttctagagggaaagcttactacaatatttcc

SEQ ID NO: 46837 - DNA, 201 bp, Homo sapiens
agtgcatcctggaagtttgtgtttttattcttttactacaagtttaagtaaacaactgtagtagtgtgcgtgtgtgtgtgtgtgtgtgtgtgtgtgtgtgtatatatatatatatatatatataattttttgttgttgtttatttcttttgagacagagtcttgctctgtcgcccaggctggaatgtagtggtgcaatctt

SEQ ID NO: 46838 - DNA, 201 bp, Homo sapiens
gtgcatcctggaagtttgtgtttttattcttttactacaagtttaagtaaacaactgtagtagtgtgcgtgtgtgtgtgtgtgtgtgtgtgtgtgtgtgtatatatatatatatatatatataattttttgttgttgtttatttcttttgagacagagtcttgctctgtcgcccaggctggaatgtagtggtgcaatcttg

SEQ ID NO: 46839 - DNA, 201 bp, Homo sapiens
ggaaggagaggaggagcccggcatgggaagatgtgtggagagtgatggggaggggtgttggaaggagaggaggagcccggcatgggaagatgtgtagagcrtgatggggaggagtgttggaaggagaggaggagcccggcatgggaagatgtgtggagagtgatggggaggggtgttggaaggagaggagaagcctggcat

SEQ ID NO: 46840 - DNA, 201 bp, Homo sapiens
gcatcctggaagtttgtgtttttattcttttactacaagtttaagtaaacaactgtagtagtgtgcgtgtgtgtgtgtgtgtgtgtgtgtgtgtgtgtatrtatatatatatatatatataattttttgttgttgtttatttcttttgagacagagtcttgctctgtcgcccaggctggaatgtagtggtgcaatcttggt

SEQ ID NO: 46841 - DNA, 201 bp, Homo sapiens
gcaggtggattatctgaggtcaggagttcaagaccagcctggccaacgtgggggaaccctgtctctactaaaaatacaaaaattagctgggtgtcgtggcrcatgcctgtaatcccagctacttgggaggctgaggcaggagaatcatttgaacctgggaggcggagggtgcagtgagccaagattgcaccattgtactcc

SEQ ID NO: 46842 - DNA, 201 bp, Homo sapiens
tttgtgtttttattcttttactacaagtttaagtaaacaactgtagtagtgtgcgtgtgtgtgtgtgtgtgtgtgtgtgtgtgtgtatatatatatatatrtatatataattttttgttgttgtttatttcttttgagacagagtcttgctctgtcgcccaggctggaatgtagtggtgcaatcttggttcactgcaacct

SEQ ID NO: 46843 - DNA, 201 bp, Homo sapiens
ctgggatcaagtgattcttttgcctcagtctcctgagtagctgggactacaggcacatgccaccactcctggctaattaaaaaaaaatttttttttagagwtggggtcttgttatgttgcccaggatggtctcaagctcctgggctcaagcgatcctcctgccttggcctcccaagggcattgggattgcaggcatgatgt

SEQ ID NO: 46844 - DNA, 201 bp, Homo sapiens
gcggattgcctgaggtcaggagtttgagaccaccctggccaacatggtaaaaccccatctctaccaaaatacaaaaattagctaggcatgttggcacatgmctgtggtcctagctacttgggaggctgaggcatgagaatagcttgaacccaggaggtggaggttgcagtgagccaagatcgtgccaccgcactccagcct

SEQ ID NO: 46845 - DNA, 201 bp, Homo sapiens
tactaaaaatataaaaaatagccaggtgtggtggtgcacgcctgtaatcccagctactcaggagcctgaggcaggagaatcacttgaacccaggaggtggrggctgcagtgagcctagatcgtgccactgcactccagcctgggcaacagagcgagaccatgtctcaaataataaaataaataaataaataaataaaacaa

SEQ ID NO: 46846 - DNA, 201 bp, Homo sapiens
caagaccttgtctcaaaaacacaaaaacaaaaacaaaacaattaaaaattagctgggcgtgatggcatgcacctgtagtcctagctattcagaaggctgasgcaggaggatcggttaagcccaggaattcaaggctacagtgagctctgatggcgccactgtactcctgtcctgcctgggtgacagaacaagaccctgttt

SEQ ID NO: 46847 - DNA, 201 bp, Homo sapiens
cggtaacacccaagctggtgttcagcaaaataagtgcccctttgttctttgtttcttttgtcttaaaaacatgtatttataattacattattatggaaaarttgttttagcaggttttttttaaataaatctggcatttataaccatgtaaaaaatagagctatcttagattttttggaaggaatagggtatacacacaca

SEQ ID NO: 46848 - DNA, 201 bp, Homo sapiens
cattgttacagcctgactcctttcatcttgtctctctccttcctcctcctcacctgtagggtttcaagtggaaaatcgagattatttactgctttagtaartaaacttaacgcccagtgtactttgggtggtcagcatttcactagatgatttctaaggtcccttcagctcattctaatcagaatttgcgatcttgagggc

SEQ ID NO: 46849 - DNA, 201 bp, Homo sapiens
aaaatacaaaaattagccaggtgtggtggcatgcacttgtagtctgagctgctcaggaggctgaggtgagaggattgcttgagcccagaaggcagaagttkcagtgagccatgatctcaccactgcactccagcccgggtgatggaatgagaccctgtctcagaaggaaaaaaaaaggacataaaagacttgacagctaaa

SEQ ID NO: 46850 - DNA, 201 bp, Homo sapiens
tgcatgcaatggtcagctttactttaggatacaggtctcccacaagccaggataaaggcttccctttgtagatacaacctgtccccttaaatctttagctstccccaaaagagtttgctaaatttccttagagaagtgggttgacaccttgtttttctcccaccttcatcttgagtaagcccaatctttctagaaaatagt

SEQ ID NO: 46851 - DNA, 201 bp, Homo sapiens
agcaggaggtgctggaccaggcgctgcagcagaacaggtggggcatgcgccctgcgccatggcccgcagagatgtctgaatgtctgattgagggttctgckaaaaccctctgggcctgttttatttgttccattgtttaattttgtttctacattttactctgatctgaatgtaatattggtctcaagttttatttgctcc

SEQ ID NO: 46852 - DNA, 201 bp, Homo sapiens
agtggcattgtgtttctgctcttttgctaatttaaaacaaatggtaacaggaaaatatgttataaaattatcaaatacataattacattcttaactaaaayattttacgggagagtttctaagaaattaataaggtacaataaaaccctaataaattattctaaacttacattttcaagatgacttttaaaattctaagta

SEQ ID NO: 46853 - DNA, 201 bp, Homo sapiens
  misc_feature (1)...(201): n = A,T,C or G, or insertion/deletion polymorphism (see Tables 1-2)
agcagcaccagaactgagaaatatagatgcgtgggtatgtgtgtgttataatttacgtacattttatttcaggaggaaatgagaatgtttaggatgcgagnccaagaagtggtgaaagaaaatgaagaattgcaccaagagttaaataagagtagtgctgttaccagtgaggaatggcaagtggcattgtgtttctgctct

SEQ ID NO: 46854 - DNA, 201 bp, Homo sapiens
gcctttcaaagtacctggattacaggtgtgagccactgtgcctagcccctttttctttttttcaccatcattataatgtgttattcatagtgtctgtacawatagaccagcagcattaagctacaccggtattgattatatgtatattaattagcccctactatattaaaacacttttttttttttaaattgagatggggt

SEQ ID NO: 46855 - DNA, 201 bp, Homo sapiens
gtgtttctgctcttttgctaatttaaaacaaatggtaacaggaaaatatgttataaaattatcaaatacataattacattcttaactaaaatattttacgrgagagtttctaagaaattaataaggtacaataaaaccctaataaattattctaaacttacattttcaagatgacttttaaaattctaagtaggttctcaa

SEQ ID NO: 46856 - DNA, 201 bp, Homo sapiens
ctgtacatatagaccagcagcattaagctacaccggtattgattatatgtatattaattagcccctactatattaaaacacttttttttttttaaattgakatggggtctcactgtccccaggctggagtgcagtggcacgatcctagctcattatagccacctcctcctgggctcaagtgatcctcccacctcagcctcc

SEQ ID NO: 46857 - DNA, 201 bp, Homo sapiens
actctgggcctctgtaccaacccaagcctgcctctcctcatcttccatccccacctgctcttcacagtgtgctcctcatctgggggagcatctgccagacacagacctgggtggtcatcctgggtctgcttctctctcactgcccgcacccagccagccaccagcccctgagtcctgctctcatgtgtccttttctctgtg

SEQ ID NO: 46858 - DNA, 201 bp, Homo sapiens
agcctttttggaggacctgctggacgccagcccttgggattcaaaggttaagaaaaccttttctggccaggtgcagtggttcacacatgtaatcccagtaytttgggaggccaaggcaggcggattgcctgaggtcaggagtttgagaccaccctggccaacatggtaaaaccccatctctaccaaaatacaaaaattagc

SEQ ID NO: 46859 - DNA, 201 bp, Homo sapiens
ctgggcttggtgtcatacgcttgtagtcctagctactgggaggctgaggtggaggattgcttgagcccaggaggtaaaggctgctgcaagccatgattgcrccactgcactccagccagggtgacagagtgagaccatgtcttaaaaaaagaaaaaaaaaaagacctgcttcactgttctttctcttcctcttaggcagcc

SEQ ID NO: 46860 - DNA, 201 bp, Homo sapiens
ttcagtttttatccctaagagaagcataaaaaagctcctcctttaccgtagacttaccaatgattatattttccttgctacttttataggttaaaaaaagaatagtattttaatttgtatttctgttattattgaacttgaatattttttcatatctttgcaagtcattttctttttctttcataaagctgcccactttat

SEQ ID NO: 46861 - DNA, 201 bp, Homo sapiens
ttccggccagaaaaatcgacaccccaaaaatcccataacacttggtaggaaccaacctatatcagcctgataagccatgctggacatttgcctgccgttgagagagtggtgctgcccatgagggtttttatgcccagtagagacaggattgacgaggggaccatagttaggaatgattgtgatggtatgaggggggattca

SEQ ID NO: 46862 - DNA, 201 bp, Homo sapiens
aaaaaaaaagacctgcttcactgttctttctcttcctcttaggcagcctctgtccctacccccaggctcctgccaatggaaatatctcctcctcatcagcrgcaggtcccattcctggcccatgggcctctctaaaggacaactctgtgtccctgccatgttgggatgaaacaaaatttcagcagctcctatatagctaac

SEQ ID NO: 46863 - DNA, 201 bp, Homo sapiens
ctagcctctggtagctatcattataatctccacctccatgaggtcaacttttttagcccccacatatgaatgagtacatgccatatttatctttctaggtstggcttattttacttaacgtaatggcctccagttccatccatgttgctgtagatgacatggttttgttcttttatatggccaaataatatttcattgtgt

SEQ ID NO: 46864 - DNA, 201 bp, Homo sapiens
atgtaaatgttttctgacaatgtagtaataatacaaccaaggaaactgatgggcaaagggggaaggaaggtagaaagtagattgcacttgctgatttcttrgtaggtaataagagtcaagggatatcattaaagctgaaaaaccaagtggtacgagcttaagcatacttaagcaggtgaacagaaggaggggaaaagtgaa

SEQ ID NO: 46865 - DNA, 201 bp, Homo sapiens
tactctatcctctttacttctgtacatgtttgaaattttacatctgaaagcgttttctgaagcagtccgtaattcagacttcacggctgtccttcctcgcmtgactgcaaatggcaggatttgctgctgtgttaatatgtttaacatgaagacatgacttgatattcattacctgtaatgcagccattgcttccttttaga

SEQ ID NO: 46866 - DNA, 201 bp, Homo sapiens
gattttcatgacagtactgtggttaagtaaatgaatgtttttgtttttaggaaatacaagtatttagaggaaaaggggcattatatctgcaaattactctmaaacatttcagaaaaaatatttctctcatatatacatatatacatatagatagatagatgggtaggtgtatgggaaagtggatggatggatggatggatg

SEQ ID NO: 46867 - DNA, 201 bp, Homo sapiens
caaggacagccaccaggagcgcctccaagaaggtgaggtccttccagtgaggactggtcatgcattgatgtcactattgtcattttacccttctatctctstcctgccgggggccccagttgaaaatgagagaagtcatgttttgcatttttgactggaatgtggctgtttataacctttccacgtcactaccctcaatgc

SEQ ID NO: 46868 - DNA, 201 bp, Homo sapiens
ttacccttctatctctctcctgccgggggccccagttgaaaatgagagaagtcatgttttgcatttttgactggaatgtggctgtttataacctttccacrtcactaccctcaatgcatagattgctttttcagactccacagtgtctctcatcatcccatgggtttgtaaatcactcgtaggtaatagtgctagactcag

SEQ ID NO: 46869 - DNA, 201 bp, Homo sapiens
aacagaaagaggatttctggtcacatggggcagggaaaaccttttgacctctatgattcagtgagttgcctgtgctattttcccattgcccagaaacagcsattcactttgaccaattagatattttctttttattttttttgagacagtctcactctgtcgcccagactggagtgcagtggcatgatctaggctcactgc

SEQ ID NO: 46870 - DNA, 201 bp, Homo sapiens
ctggagtgcagtggcatgatctaggctcactgcaacttccgcctgccaggttccagcgattctcctgcctcaacctcccgggtagctgggattacagtcaygcgccaccactcccggctaatttttgtattttcagtaggggtgtttcaccatgttggccaggctggtcttgaactcctgacctcaagtgatccacccacc

SEQ ID NO: 46871 - DNA, 201 bp, Homo sapiens
ttttcagtaggggtgtttcaccatgttggccaggctggtcttgaactcctgacctcaagtgatccacccaccttggcctcccaaaatgctaggattacagrcgtgagccactgtgcccagccaccaattagatattttcatagagtagagagatgtacagttttatgctataataaatacctctaagtgctagtgtcggca

SEQ ID NO: 46872 - DNA, 201 bp, Homo sapiens
aacccaggaacgtgacagtcttatgtgtttggtaagtttcctgaaggttacatcaagtaaactgcgagttaatatgcaaatgtgattttaagagtattttwaaaaatgatctattaaaagctttatccaggcattccctgacttacgatggatggttccacctaggaattttcgactttatgatgtatttattgggaagta

SEQ ID NO: 46873 - DNA, 201 bp, Homo sapiens
atcctagctcattatagccacctcctcctgggctcaagtgatcctcccacctcagcctcccgagtagctggggctttaggcacgcggcaccacaactggctttttttttttttttctatagggccagggtcttgttatgttagccagactggccttgaactcctgggcttaagcaatcctcttgcttcgggctcccaaagt

SEQ ID NO: 46874 - DNA, 201 bp, Homo sapiens
ccatggtggcagccggaggtgcgtaagcccactgaacgctgcagggcagggaagaaataaatggtctcatagtttaatccattgataacattttgctttattttttaattttttttttttttttagagctagggtctcactctgttgcccatgctggagtacagtggtgcaatcatagctcacggcagcctcaaacatgtt

SEQ ID NO: 46875 - DNA, 201 bp, Homo sapiens
ccatgttggccagactggtctcaaactcctgacctctttcttaatccgcctgccttggcctctgaaagtgctgggattacaggcatcaaccaccgcacccrgcccattttcttttttttttttaattattaatttttttttcaaggcaagatcttgctctgttgcccaggctggagtgcagtggtgcaatcatggctcact

SEQ ID NO: 46876 - DNA, 201 bp, Homo sapiens
cagaaaacacctgttggtcagttggcgtattttttaaatattagatttatgtaaaaggtgcatctctttttaaattacaaaagtaatactgtctcactgtaaaaaaaatacataaatatataaagtgcattagtccgttttcacgctgctgataaagacatacccaagactgggtaacttatcaagaaaaagaagtttaat

SEQ ID NO: 46877 - DNA, 201 bp, Homo sapiens
agctctggttgcccccagcctcaatggcgtctctcaggcagacctgctggacggctgcgatgtctgctcctatgacctgaagtctcatgcccccacctgcyagaatctgcgggagcccgtggtgtagcctcctctggcctgaaaggtctgcctcacacaggccttccctgcagggcagcccatggtggcagccggaggtgc

SEQ ID NO: 46878 - DNA, 201 bp, Homo sapiens
ggtcttgctatgttgctcaggctggtcccaaactcctgggctcaagtgatctgcccatcccagcctctcaaagttttgggattacaggcatgagccactgygcccagctgatttaatgactttttgagtataatgagtcactctgcctgtggttataggcagaatggagagaggttgctcagttctttctgggtttcttca

SEQ ID NO: 46879 - DNA, 201 bp, Homo sapiens
gcgtgtatatatatacctatgtatggtatgtatgtaattggtaattggccaattggtaatagtccgggtaggaggattgcttgagcctaggagtttgagawcagcctgggcaacattgtgaaacaacaacaacaacaaaaaaaaaatatatatatatatatggtggctattttctcatgtcaaaaagaatcttgtatgtgt

SEQ ID NO: 46880 - DNA, 201 bp, Homo sapiens
caggacaaccccagagctctggttgcccccagcctcaatggcgtctctcaggcagacctgctggacggctgcgatgtctgctcctatgacctgaagtctcwtgcccccacctgctagaatctgcgggagcccgtggtgtagcctcctctggcctgaaaggtctgcctcacacaggccttccctgcagggcagcccatggtg

SEQ ID NO: 46881 - DNA, 201 bp, Homo sapiens
ttatttgggaatctaccttcagggaaaaccgaagaatccgagaacttctccaggacacactcacgaggacaggcgtgcaggacaaccccagagctctggtkgcccccagcctcaatggcgtctctcaggcagacctgctggacggctgcgatgtctgctcctatgacctgaagtctcatgcccccacctgctagaatctgc

SEQ ID NO: 46882 - DNA, 201 bp, Homo sapiens
gccacccacatacttgggaacgtgcacctggcacacaggtggtggttgggagggattgcagctcctgcagtgatgcctggtttgtggtgggcattaaaagyccctgcatacttctgaaaaaccccagaccccaaactgtaatttagtggctcagggctgggcccagaggtctgtactttttttttttttttttttttgaaa

SEQ ID NO: 46883 - DNA, 201 bp, Homo sapiens
ggactagacccagaaacgtctcagagactcccagttacagttacctaaagcggagctctctgactttcattgtgtataggagctagttttcattactctcrtcttggagataagccacctaaaagcttatattaagcccctatgaggtgtgaggcaatgtgctcaatgctagagttccaggattgataaagataagagagt

SEQ ID NO: 46884 - DNA, 201 bp, Homo sapiens
ggtctattcccagtggactgtggccctgtgaggatgtggccaccttcatctgtcctgtctccccagcacaccacagggcactgcatcctggttctggaaaygctgccctgtggctctttccaacctcacatgcctcggcccctcagggcctccccatcccggcacatgggccaggccaatcttctccatcttggcaatgag

SEQ ID NO: 46885 - DNA, 201 bp, Homo sapiens
gtaccactgcactccactctgggcaacagagcaagaccccatctcaaaaacaaaacaaagcgaaaaacaataaggatatcacttgcttctcaggaagtcgycctgctctgcagggggagccacatgagacatcactggggggagtgctgtgggacacatggaagagctagagggtgactcttggggacagccagggaagct

SEQ ID NO: 46886 - DNA, 201 bp, Homo sapiens
caccctctacagaggaagccttccatggtaccaactggctgggtggaaatgctgcagtaacatgagctggccatgaaggtggatttggagatgagaggccrtggccacccacatacttgggaacgtgcacctggcacacaggtggtggttgggagggattgcagctcctgcagtgatgcctggtttgtggtgggcattaaa

SEQ ID NO: 46887 - DNA, 201 bp, Homo sapiens
aaaagaaaattgaggtcctcaaaaagcaggtggaaaaagccatggggaacgaaatgtctgctcatcagtacctggcaaaccttgttggcctggcagaaaayataacccaggaacgtgacagtcttatgtgtttggtaagtttcctgaaggttacatcaagtaaactgcgagttaatatgcaaatgtgattttaagagtatt

SEQ ID NO: 46888 - DNA, 201 bp, Homo sapiens
gtagctgggattacaggcacatgccaccacgcctagctaatttttgtatttttagtagagatggggcttcaccatgttggccagactggtctcaaactccygacctctttcttaatccgcctgccttggcctctgaaagtgctgggattacaggcatcaaccaccgcacccagcccattttcttttttttttttaattatt

SEQ ID NO: 46889 - DNA, 201 bp, Homo sapiens
gggaaaccgccccatgattcaattatctcccactgggtccctccgacaatatgagggaattatgggagctacaattcaagatgagatgtgagtggggacasagccagaccatatcataaagctaaacacacttaattgtgctcccacagataagatttttaacaatttagagagtatatgtatataaagtgcatgctgttt

SEQ ID NO: 46890 - DNA, 201 bp, Homo sapiens
ctcccaagtagctgggactacaggtgtgtgctaccatgcccagccattttttaaaattttttgtagatacagagtctcactgggttacccaagctggtctsgaactcttgggctccagtgatcctcccgtcttggcctcccaaagtgctgggattgcaggctggagccactgcacccggcccctttgtctccggttctgat

SEQ ID NO: 46891 - DNA, 201 bp, Homo sapiens
aacaaaggtagggaaaagttttcagtttcctaagaggtggctcacatttgagaagtgacaaggagagccaggcatcaagtggacaaccaataactactttrtcagcagccctagagttgctcgggctcagggaaacgtttctgtaaatcatttctcagggaacacagaatgccagcctcataatcctggggccagaaaaca

SEQ ID NO: 46892 - DNA, 201 bp, Homo sapiens
ttataacaaaaaggtgccattgttacatgaggtgaacagtgaagacgatgaaaatatttctcatcaagatgggtttccaggctcccctcctgcaccacagyggacacaacaaaaaggtagaaaaaaaaagccacaatttttataaaatataagaacattttttcataatgaatattgcttatttttaggaaaacataccca

SEQ ID NO: 46893 - DNA, 201 bp, Homo sapiens
caattctcatgcctcagccccactcatagctgggattacaggcatgtaccaccacatccggctagttttgtattttgttggccaagctggtcctgaactcytggccttaagtgatccgcctgcctaggcctcccaaagtgctgggattacaggtgtgagccaccagcctggccttttgtatgtttttatatttccaagtgt

SEQ ID NO: 46894 - DNA, 201 bp, Homo sapiens
  misc_feature (1)...(201): n = A,T,C or G, or insertion/deletion polymorphism (see Tables 1-2)
agcagtattagaaatcagctttgagcctcgcctaagtcatacactaaaataaattcctaatgaatgaaggactatactctatagacacacaaataagactntgaaatccaatatccagtcttatcacacctcttcagggatatgactgctatttgcttttacaccaagaatttagaaagtaaaaaaacctttttaatcgct

SEQ ID NO: 46895 - DNA, 201 bp, Homo sapiens
ctctcggtacctgcacacctgcacggctgctaaacctgcatgcagcactcggtacacggacttcacacttcagcagacactttctttctttctttctttctttttttttttgagacagagtcttgctctgctgcccaggctgaagtgcagtggcgcgatctcgactcactgcaacctccacctcctgggttcaagtgattc

SEQ ID NO: 46896 - DNA, 201 bp, Homo sapiens
ctgaggcaggagaatcatttgaacctgggaggcggagggtgcagtgagccaagattgcaccattgtactccacctgagggacagagtgagactccgtctcaaaaaaaaaaaaaagcaactcgatgtccaactttttacaacatgaatgtgtacaggcaaactggggtgtaagatcacctgcttcctagggtacctggatta

SEQ ID NO: 46897 - DNA, 201 bp, Homo sapiens
tgggttgacttttttgagacagagtctcactctgttgcccaggctggagggcagtggtgcaatcctggctcactgcaacctctgcctcctggattcaagcrattctcctgcctcagtctcctgagtagctgggattacaggcgtgtgccacctctcccggctaatttttgtatttttagtagagatgagattttgccatgt

SEQ ID NO: 46898 - DNA, 201 bp, Homo sapiens
gtctcctgagtagctgggattacaggcgtgtgccacctctcccggctaatttttgtatttttagtagagatgagattttgccatgttggccggtctgtaactcctgacctctggtgatccgcccaccttggcctcccaaagtgctgggattacaagtgtgagccactatgcctggcctgtgtaggcttttttgatatacta

SEQ ID NO: 46899 - DNA, 201 bp, Homo sapiens
tacaggcatgcaccaccacacccggctaatttttgtatttttagtagagatgtggttttgccatgttggccaggctgatctcaaactcctgaccttaagtsatccacccgcctcggcctcccaaagtgctgggattacaggcgtgagctaccgcgcctggtcttattttgcatttctctaatggctaatggtattgagcat

SEQ ID NO: 46900 - DNA, 201 bp, Homo sapiens
caacattttccagaaccatctggcagtgtccgggaaggagctggcctctccagcctggccatgctccccgatggggctaagcaccttgtgaggtgtggctsgtgtcctggtctattcccagtggactgtggccctgtgaggatgtggccaccttcatctgtcctgtctccccagcacaccacagggcactgcatcctggtt

SEQ ID NO: 46901 - DNA, 201 bp, Homo sapiens
gattgagggttctgctaaaaccctctgggcctgttttatttgttccattgtttaattttgtttctacattttactctgatctgaatgtaatattggtctcragttttatttgctcctcatcttctttattcttttaaaaattcctcttgtttgaactggacttccggaatcaatgcacacctctaattgcctttctctttt

SEQ ID NO: 46902 - DNA, 201 bp, Homo sapiens
tggcatgcacttgtagtctgagctgctcaggaggctgaggtgagaggattgcttgagcccagaaggcagaagtttcagtgagccatgatctcaccactgcrctccagcccgggtgatggaatgagaccctgtctcagaaggaaaaaaaaaggacataaaagacttgacagctaaatgcaacatgtgaccctgaattggatc

SEQ ID NO: 46903 - DNA, 201 bp, Homo sapiens
gtaagaaaagctctgtccaaggcacaatgtttctaaggaccattctgtttcttgcctccttcccttccttcttccccgtaataaaggcaataaagactgtwaaacattgggacaatacagaagtgtacaaagtaaaagaggccggatgaggtggcttgtgcctataatcccagcactttcagaggctgaggcgggagaatt

SEQ ID NO: 46904 - DNA, 201 bp, Homo sapiens
tttttaatagagacagggtttcaccatgttggccaggctggtcttgaactcctgacctcaagtgatccgcctgcctcagcctgtaatagtgctgaaattasaagcatgaactgctgtttccaatggtgatattttatgttttcatttatttatagcatataaagaactaggctttatatacattaaaatttggttttattg

SEQ ID NO: 46905 - DNA, 201 bp, Homo sapiens
gtactatacagtaaaaacgaaagaaggaaagtaaatagcgggctttcatctcagctgtctgtttggtgacagagagtgacagcccttgttggattcttcartgaggctgtcttgtcaaggtgaaacagtgctgaccagtggcagcattagttcttaggttaccagttgatgcagggataagagttgtcctggaaaaaatac

SEQ ID NO: 46906 - DNA, 201 bp, Homo sapiens
gttggagtacagtggcgtgatcttggctcactgcaacctctgcctcccaggttcaagcaattctcctgcctcagcctccccagtagctagaattacagatrtgccaccacgcccagctgatttttgtatttttaatagagacagggtttcaccatgttggccaggctggtctggaactcctgaccaggctggtctcgaact

SEQ ID NO: 46907 - DNA, 201 bp, Homo sapiens
gctggagtgcattggtgcgaacgtgactcactgcagcctcaaccccctagcatcaagcgatcctcctgtctcagcgtcctgagtagctgggactacaggtrcacaccaccatgcctggctaattttttaaattttctgcagagatggaggtctcactatgttgcccaagttggtcttgaactcctagggtaaactgatcct

SEQ ID NO: 46908 - DNA, 201 bp, Homo sapiens
ctcctgcctcagccgcccaagtagctgggattacaggcaagtgccaccatgcccggctaatttttgtgtttttagtagagatggggtttcactatgttggmcaggctagtcttgaactcctgacctcaagtgatccatccacctcagcctcccaaagtgctgggattacaggcatgagccaccgtgcccaaccaggaagta

SEQ ID NO: 46909 - DNA, 201 bp, Homo sapiens
  misc_feature (1)...(201): n = A,T,C or G, or insertion/deletion polymorphism (see Tables 1-2)
tcccaacagcatggcagcccactccctgggtgctggtagcaggcaagaggcacccccacagtgcccaggagccagtgcacaccactgttggggccacaccnttgttacagcctgactcctttcatcttgtctctctccttcctcctcctcacctgtagggtttcaagtggaaaatcgagattatttactgctttagtaagt

SEQ ID NO: 46910 - DNA, 201 bp, Homo sapiens
gcctgcctaggcctcccaaagtgctgggattacaggtgtgagccaccagcctggccttttgtatgtttttatatttccaagtgtcctattcacttttgtartaagggggaaataatgttttaaacggtgagcctttcagctcaaaatggttgactgaatacctattgacttctgtttctctccaactcctccttctccctc

SEQ ID NO: 46911 - DNA, 201 bp, Homo sapiens
gcagagatggaggtctcactatgttgcccaagttggtcttgaactcctagggtaaactgatcctgggaggctgaggcaggagaattgcttgtgcccaggartttaagatcagcctgggcaacatagcaaatccttatctatagcaaaaatcaaaagaaaataaattatctgagcatgatggtgcatgtctgcaatcccaga

SEQ ID NO: 46912 - DNA, 201 bp, Homo sapiens
aacagggtatatttacatatatataaaagacacaaaaattgatcattgcttggctacaaagaaagcctcaataaatccctaaagtagaaataatgtaggcrtttgttttttgtttgtttgtttttagacagagtctcactttgtcgcccaggttggagtacagtggcgtgatcttggctcactgcaacctctgcctcccag

SEQ ID NO: 46913 - DNA, 201 bp, Homo sapiens
gggaaataatgttttaaacggtgagcctttcagctcaaaatggttgactgaatacctattgacttctgtttctctccaactcctccttctccctccatagygttggtgtggggcaacaaatgagctagtgcatgtgaagcttggtgcttaagtaaatgctagtgattccaattactggagcctggttttgactctgctatt

SEQ ID NO: 46914 - DNA, 201 bp, Homo sapiens
gctgggtgtgtgggtccctgtagaggaggctgagcaggaggatcacttgagttgagtctgagagttcgaggctgtagtgcagaatgatcaggtctgttaayagccactgcactccagcctgggcaacatagtgagatcctgtctacatcatcatctatagtaattgtgagtatctatgcgctaaataacacagcagcaaat

SEQ ID NO: 46915 - DNA, 201 bp, Homo sapiens
ttgttgtagtagaggaaggaaacatttttgaaatcatgttcatctttataattttatttttctcaaacatctgctcctgcgaccaatgtgtttttgtggcwgtgtcataactacaaaaacatacagccatgtaccacataacaatgcttcagtcaacaatggaccacatatacgacagtggtcccatacaattataatggg

SEQ ID NO: 46916 - DNA, 201 bp, Homo sapiens
aagaaaaagactatattagtttaaaatcttttaaaaatatgtacataaaacaaccaaacataaaataacaaaattgagaccaaagaaatgtgtcctatagrtaaatgtaaattagcttaattcacctattagggaaaacaatattttttggattggctcataaagcaaaatgctattccacactagacccaagagccaacc

SEQ ID NO: 46917 - DNA, 201 bp, Homo sapiens
catgcagttatggacagtacataatacttgataatgatagtaaatgactgtgttactggtttatgtatttaccctactttttattgttattttagagtgtmctccttctacttataacaaaataaagttaactgtaaaacaggctcaggcgggtccttcaggacgtgtccagaagcaggcattgttatcacaggaggtgac

SEQ ID NO: 46918 - DNA, 201 bp, Homo sapiens
cctcacatgcacccaccactcactgactcacccagagcaatttctttccagtcctgcaagctctattcatggttaagtgccctgtacaggtgtaccatttctctctctctctctctccctccctccctccctctctctctcgctctctctctctctctctctctctgaggcagagtctcgctctgtcacccaggggctgga

SEQ ID NO: 46919 - DNA, 201 bp, Homo sapiens
tgttttcaaatgtcttaacatcactggaaaaaatgaagtattttctatatgtgatgtttagaaatctggaattgagtcaacagcattcttaccattggctytccctgattttgtggtcaccgatgcgtcaggtgggactggctcaggcagctcctgggtcttggtgctctgtgacctccctggctgagcttggattttctt

SEQ ID NO: 46920 - DNA, 201 bp, Homo sapiens
gtcttgaaaagcctaaaagcaatatccaggcaggactaagaaaacaaaaattactcactttgaatagctatgttatatttagtgttttcaaatgtcttaayatcactggaaaaaatgaagtattttctatatgtgatgtttagaaatctggaattgagtcaacagcattcttaccattggctctccctgattttgtggtca

SEQ ID NO: 46921 - DNA, 201 bp, Homo sapiens
agtccctctgaccagagtggaaactcgtggagccttttctgggcctgccaatggcccaatcagcacacacttcttccccgctgaggtccataaaaaccctrggctcagccagagcagcgcagagaatagccagaggatgaagatggtagagacgaggggacaggatgaccagctgcagagagcagtaccctctctgctgat

SEQ ID NO: 46922 - DNA, 201 bp, Homo sapiens
catattcgagctctgatgaattcctgcccctcttccatgttataaattctctctccaaacaccgccccttccgcgggacagcccattagggtcacactccyggctccatccttctcattcctctacccttgacccatctatcgactctgagcccaaagctgttcagccaaagctgccataaaggctttccctccccagcca

SEQ ID NO: 46923 - DNA, 201 bp, Homo sapiens
cctctgggttcctcatttaagtggccatatagatccctgaaattggaaggatccaaggagagaaatgttggttgttctgggatcctgagctgggagggtcsttaaaaaacaataacaactgcaaccaaagaaaccatttcaaaaaagtataacttcttgccatttaaaaattttctggttgtgtttagatgtaagaaatat

SEQ ID NO: 46924 - DNA, 201 bp, Homo sapiens
gaatgtggctgtttataacctttccacgtcactaccctcaatgcatagattgctttttcagactccacagtgtctctcatcatcccatgggtttgtaaatsactcgtaggtaatagtgctagactcagcagaactggttttggggtaaaatagtaccttagaaatgggaatgatcacgtgaggtaaacatctgaaataaca

SEQ ID NO: 46925 - DNA, 201 bp, Homo sapiens
  misc_feature (1)...(201): n = A,T,C or G, or insertion/deletion polymorphism (see Tables 1-2)
tgctggggaaagctttcaagagaatggagagcagaccatttggactggacctagagagaaaagtaatagcatctgctctatgccacctgccagctctctcnttcatccttcagtgttgtgacataggtattgttgctcttgttttaaagatgagggaattcttgtttttaaaaagacaagatcaaaaagatacgtaactgg

SEQ ID NO: 46926 - DNA, 201 bp, Homo sapiens
agcaggtgctgggatcttacttgtggcccctcggcctctttaccaggctcttatcctttctccctgggaggtctatccccggctggagtacttcctgttakctgaccctgggaacctgggaggtctggaggcctggcagagggcattgcgggactcatgccctgagccactctgctaatgactccttttctcaggcgctga

SEQ ID NO: 46927 - DNA, 201 bp, Homo sapiens
cattcagataaaggtaacagcatgagccacagagggagggagaggaaaatgcaggcagtgttcaaagaaccaggcagtgcactgtggttgtgcctgtaatygggtggttggtagcaggggaggtgtgggcaagagatgaagccagaggatttcagatttgggtgggagcgtaggccagaagagggaacgttggatgtagtc

SEQ ID NO: 46928 - DNA, 201 bp, Homo sapiens
gagagaaccttgtcatcgtgggagctgggccattcctacacagtggtctggcaatgacccggtggtggtggaggcctgtgagtgggcactggtaatgggarcagctgtaaaaccctggaggccagccccaggagagtgaccttaccaggaaagttctgggaaacaaaccacagggaggctttacaggaatttttggttgtg

SEQ ID NO: 46929 - DNA, 201 bp, Homo sapiens
  misc_feature (1)...(201): n = A,T,C or G, or insertion/deletion polymorphism (see Tables 1-2)
gctgtgcatcaggacgttttacatcttagagatgctgtcttaaggtctttaggctgaaaggatggtagtcagcctatctcgccacaacttacaaggattcnccaccttcccttgggagcccagcgttatctcataaccagttatcaaaaagttgacagtttttgaaatcaggtggcaatatactttagttgaaagtgtgct

SEQ ID NO: 46930 - DNA, 201 bp, Homo sapiens
gagcccctgttggactggaagggaggtaggaggagtggaatgcatgcaaaaaccgagctgatcaaaagacagtgctgtttcatggaagcctcccagaactragagagagagagagagagagagagagagagagacagtgagaaagaaagaaaaagagagcgcccttgtgcacgcgctaggccaagagcgcgccgctgtgcg

SEQ ID NO: 46931 - DNA, 201 bp, Homo sapiens
tgaactttctgaacagaatgtcttttgtattctggcaaacaatgagggggcattctgattaacttcggatcagcttgccaatgcaagcactggccatgtcsccagttccggctccctaaaatgagtacatgtatacatcgtggttgtggcctgagggtccacaagggtgaactccatggccctggacctcagacggtccac

SEQ ID NO: 46932 - DNA, 201 bp, Homo sapiens
  misc_feature (1)...(201): n = A,T,C or G, or insertion/deletion polymorphism (see Tables 1-2)
aatgttgctttccttgggttgggtcgtttcataagagtgatgtttgccataaaactggagcctcatagacgatcctgcagggaggaagctttccttggtcncctgactcatgtgtttatatatagtatagaggagaggtattccaaaagacccgtcgcttttcctgtgtcccacagctgcctgtagagttgtggcaccata

SEQ ID NO: 46933 - DNA, 201 bp, Homo sapiens
tttattttacttctcccattcaagtactaacggggcctgaccctgcttagcttttgagatcagacgagatggcacattcagggtagtatggctgtagactstcacttctgtttagttatttatgtgaacaaggtttcttggtgcttaccactataaaaatgaaaaattaatgcattttgaataaaattttactttttatgt

SEQ ID NO: 46934 - DNA, 201 bp, Homo sapiens
  misc_feature (1)...(201): n = A,T,C or G, or insertion/deletion polymorphism (see Tables 1-2)
gcaaaccagtggagtatttaaagtaaaatttcagaatcccttttggagctttcggttgagaccaggctccttggaaccctagtgctttgggagttctgctnctgctgcagtaccaaaagtagcttctttgaatttcatttgggttttgtagggctcccccgaggcccgagaactgggagaagggaaagagctcatcggttt

SEQ ID NO: 46935 - DNA, 201 bp, Homo sapiens
gcacatttaggctgtcttcagtctctttctgttaaaatataacagtaattatccacgaataaacataatttaatgttaattttgataatgccactgttttrgtgggagaggcagataagctagtagtcttcagacaggggatattttctagatccttgactttctatgtcccctttccaaaggctgatctgtctgagaatt

SEQ ID NO: 46936 - DNA, 201 bp, Homo sapiens
gcctttaatcagagtcagtgtcctgagactgtcagacactggtctctgggaagtgctctgtatcactatcatttatatacttttcctttcttgtgtcctayagtttttgaatatctcctgcggaaaaagcactggggtgtgtacgggcatctgtttattctcttattacctttcttcagtgaatatgcttaatgttagggg

SEQ ID NO: 46937 - DNA, 201 bp, Homo sapiens
agtggggaatgatgcacatgaggaccttcgaagggcttgtaggagctgaggctgtgggaataaagtgtgggccctgattctgaagggacttgattcagtcstgaagagaaaccgtgtatttttggtttctagacactctgtaatttatttaatcagacctttattgagcacatttaggctgtcttcagtctctttctgtta

SEQ ID NO: 46938 - DNA, 201 bp, Homo sapiens
ccttgagaatcaatatcagccattctgtaaatttgatgacaaatattgagagcttgctgtgaggaaggcattccattacagggattagcttttcttttctyttctatcgttaagctttgttttctttgactgcttatacccttttcctatatattcattcttctctgtttactgatctttctttcatagtttcaaactatt

SEQ ID NO: 46939 - DNA, 201 bp, Homo sapiens
ttgcctactgtgtggatacagggtgcacagcacttggtatttctcgggctctttgcatctgcctgctccgttggctcactgtggggatgctggcaggggcwtggtgtcttgttttcttagaatgaatgatgcagatgagcagcctctctagatgatgggaaaatttagcatgatccatcatgatccatcaggctaaatttt

SEQ ID NO: 46940 - DNA, 201 bp, Homo sapiens
taaaccctgggttaagaatctgctttactgttttttttttcttgaggccattttatttttgtgtcaaatacctaagcaatacctggtactcagtagatacscaataaatattaatttaaaaaacttcttatttcaaaatatgcacaaaagtcaggagaactgattcagtatcttggctattatgaataatgatagccattg

SEQ ID NO: 46941 - DNA, 201 bp, Homo sapiens
ttttctaatgactgaaatagaaattctgacaatcattgaaggttcagttccaaccctctttctctaaattctagtaagaatctctactagttctgcaaatycccatatttcctcctctttatctcttgtatgctattatttttgagtagttgtttattaatgcctttatcactagattttaaatttgcttacacaacttat

SEQ ID NO: 46942 - DNA, 201 bp, Homo sapiens
cttctcttaagatcttgattaataaccctgtaacttatgttaatgatattaaccaggagtactacatttatttttctcctttaattctgtgtagatctaamtaaaataataaagtgttgaatatctcatgtaatttattgaatactgtaccgaaactgaaaaacagaatgctgtatggggactcaacgtatgctttctact

SEQ ID NO: 46943 - DNA, 201 bp, Homo sapiens
catcagtccggcttcccagagctgagtcacaaattggatctgtctatgttccttaaggattaaaaagtaacattcctgttctcactccctctttcctcctyctaccccgcttcctgtaccttctccccttgggctctctctctctcaaattagatatcagtcaccccgggaagatgaaactttgaaatacactggagaaca

SEQ ID NO: 46944 - DNA, 201 bp, Homo sapiens
aaagtaacattcctgttctcactccctctttcctccttctaccccgcttcctgtaccttctccccttgggctctctctctctcaaattagatatcagtcamcccgggaagatgaaactttgaaatacactggagaacaggccaaggacacccttggttctgctggttcagcctctttccctggaatgaagggcggggtgta

SEQ ID NO: 46945 - DNA, 201 bp, Homo sapiens
gtgacctgtcatcaccaaaggggttgtgtgtgagctggagatggactgttggaaatcacatagtggatggaggattatttggaactgggaaaaaatgagakaaactgagggttacgggagacaagatctgaggcaggaggaagactactggaaggaagcaggagtgaggcactgggcaaggggccctgggcggaggcagtt

SEQ ID NO: 46946 - DNA, 201 bp, Homo sapiens
tctcaaagctgcttgtgttcagttcctgccacttgacagacagctccccatgtcttatggctgctgcatcaggcagaatgatcaaagaaagggcacagggrgccatggacaaggtagggagagaaagacaattgctttggaaagtcaccagcagccaaggaggactgccctttcagacctggcctacacgttaggaaggta

SEQ ID NO: 46947 - DNA, 201 bp, Homo sapiens
ggcacagggagccatggacaaggtagggagagaaagacaattgctttggaaagtcaccagcagccaaggaggactgccctttcagacctggcctacacgtyaggaaggtacttgagagtgtcctttaagaggaaggagtaggggccaatgagattttgaggacacggcagccgcccacactggagaggccagaagtcctga

SEQ ID NO: 46948 - DNA, 201 bp, Homo sapiens
  misc_feature (1)...(201): n = A,T,C or G, or insertion/deletion polymorphism (see Tables 1-2)
agccaggtagtcagcaggtctggatgttagttctggttctgtctctaatttgctgggtgatcttggggaagtaacttgacttctctagggttcagtctccncttccagaaagtagaaggcatggattcagtgttctcattgacatcctgacttgacattttttttgagacagagtctcgctcggtcgcccaggctggagtg

SEQ ID NO: 46949 - DNA, 201 bp, Homo sapiens
  misc_feature (1)...(201): n = A,T,C or G, or insertion/deletion polymorphism (see Tables 1-2)
atatttgagtaacttttctttaaccccatcaaccagattctaggaagcattttgacttggttctcagaactcggaggctggaagcttgttctccaatgcgnagggcagtacaaggaggcctcagcctttagtaagtaagaaggtaggtttctcttggtgccctgggaaaattttggttaacagatgtttggggtacttatt

SEQ ID NO: 46950 - DNA, 201 bp, Homo sapiens
  misc_feature (1)...(201): n = A,T,C or G, or insertion/deletion polymorphism (see Tables 1-2)
aaccagattctaggaagcattttgacttggttctcagaactcggaggctggaagcttgttctccaatgcgtagggcagtacaaggaggcctcagcctttantaagtaagaaggtaggtttctcttggtgccctgggaaaattttggttaacagatgtttggggtacttatttgtttggctctgtagccttagaccaggtct

SEQ ID NO: 46951 - DNA, 201 bp, Homo sapiens
aattttctctttgagtgagggtgtttacaatgtaaggttatttttgctttagaagaccaaactctagatgatggtcaaacatcctgttcttcagctttttyacttctgcaggcttccacaggcaggggctcagattcgacagtagctccttgtagaaccaggagaagcttagcctcgatggtgcatagagctcccaaaact

SEQ ID NO: 46952 - DNA, 201 bp, Homo sapiens
gtctttctctacagggatggtgacagaatggatagtatagaaaatggattggaattgaggaggaaactagaagctaagaggagttaggaggcccttgtaaraatccaggtattattgctaagggcctagtatcattttagttatttctgtttctgtttttagagatttgtggtggtttttggagaagatgacataaaatta

SEQ ID NO: 46953 - DNA, 201 bp, Homo sapiens
acatgattatttctaccttttggtcctgtatatagtgctgctatgaacttttgtgtacaagtagttgaacaattgttttcagttcttttgggtatataccsaggagtggaattgctggtcacatggtaattctatgtttaactttttgaggaaccaccaaactgattcccacttaatttacctttttaacttcctacttca

SEQ ID NO: 46954 - DNA, 201 bp, Homo sapiens
gaaacaggaagacatgagatgaaggaaacaggagattcaacatgggtaagggtcgttcttcaaaataagtagagtaagcatgcttctgagacaggagatgsgggaatgaagatacatttggacatggtaagggaaagttgagggaatttacatttctcctttctcagtggtgaaggcaaggttacctcctgagagtgagta

SEQ ID NO: 46955 - DNA, 201 bp, Homo sapiens
aacttatactgatagataaataacccatgctttcaagaggctcacaatctggcagtcagcagattggctcatggtgagcaatacttatgaacaatggttaygggctatgaagtgagccttgggtgccaagggagagagtaatccattctcccaaggagtaggaagaagtcggagaaggctttattaaaaaggtgacatttg

SEQ ID NO: 46956 - DNA, 201 bp, Homo sapiens
tagtatgcatgtgtatgcatttctgatgggtataaaactaagaaaggaattgctgggtcatgggttatacctatatttagctttagtatataatacccaargttattccaaagtggtagtattgatttacacttcctctgtcagtgtttgagaattccagttgcttcacatccttgccaacagtaggtattttctttttca

SEQ ID NO: 46957 - DNA, 201 bp, Homo sapiens
gtgagaagaaaatagctaggacatgtgagacaagcttggcaatggcagtgaccttggtttgcagtctgtggcttggactctggctggtatgttctgagaaytgaggcttttgaatctagaaaggaaagaaaatactgaagtttcttatgttctctgcctctctccaacctcctgattgacttatccctttgggttgaaaca

SEQ ID NO: 46958 - DNA, 201 bp, Homo sapiens
gcactttaggaggctgaagtgggtggattacttgaggtcaggagttcaagaccagcctggccaacatggtgaaaccttgtctctaaatacaaaattagccrggtgtggtggccggtgcctgtaatcccagctacttgggaggctgagacaggagaattacttgaacctgggaggcggagtttgcagtgagctgagattgtg

SEQ ID NO: 46959 - DNA, 201 bp, Homo sapiens
tgactagtttctatgggttgatacttctttttctttttcgagatggattctctgtcacccaagctggagtgcagtggcatggtcttggctcactgcaaccrttgcctgcctggttaaagccattctcctgcctcagcctcccatgtagctgggattacaggcacacgccaccatgcttggctaatttttgtatttttgtag

SEQ ID NO: 46960 - DNA, 201 bp, Homo sapiens
  misc_feature (1)...(201): n = A,T,C or G, or insertion/deletion polymorphism (see Tables 1-2)
ctaatttttgtatttttgtagagagggtttcaccatgttggccaggctggtcttgaactcctgacctcaggtgatctgcccaccttggcctcccaaagtgntgggattacaggcgtgagccactgtgtccggtccatacttctttttttttaaaggtttgatcctgtttggattctatcagtagtgaaggcccgggattct

SEQ ID NO: 46961 - DNA, 201 bp, Homo sapiens
gttttgaagggagaggagggtgttaaatgagtctagattaccttattgaagaatttctccaaagaccccttctcttatttttttggctctgatgtcatgartgtactgttgttggggagggtgttgaaactatcactatactcttctcatctaaaactgcctgaatgttagatttcactgtccttataaaagagtgaatta

SEQ ID NO: 46962 - DNA, 201 bp, Homo sapiens
  misc_feature (1)...(201): n = A,T,C or G, or insertion/deletion polymorphism (see Tables 1-2)
ccatgttggccaggctggtcttgaactcctgacctcaggtgatctgcccaccttggcctcccaaagtgctgggattacaggcgtgagccactgtgtccggnccatacttctttttttttaaaggtttgatcctgtttggattctatcagtagtgaaggcccgggattctgaaatgaaaatgtatgcagtgtttataaactc

SEQ ID NO: 46963 - DNA, 201 bp, Homo sapiens
ggtcagcccaatcagcctgcttagatggaatagtttgtgaagggcagagcagggtgagactgaatttcagatttagcatagattgctagaaaacagaggartttctttggtaagtcactggattttgctttcctgtctccccttcccagtctgtttcagtaacagacttgcttctgaaggaaagataatgtagttgggaaa

SEQ ID NO: 46964 - DNA, 201 bp, Homo sapiens
gtgtccacacacacacacacacactagccaggagtggttatggggtaccagctaggtaggcaacatagcgacaacccgtgtccacacacacacacagtagsaggagtggtggcgcgcatctgtagtcccaggtactcgggagggtcgaggtgggaggatcgcttgaacccgggaagcggaggttgcagtgagacgagatcg

SEQ ID NO: 46965 - DNA, 201 bp, Homo sapiens
  misc_feature (1)...(201): n = A,T,C or G, or insertion/deletion polymorphism (see Tables 1-2)
tactctaaaacatcaacaaagcctggtaaaggtccatgctctcaatgactcttctcaccaaatccgtatcacttctggatgagatttccaggtatgtgctngtctttaaacagatgcttgtctgatttttggaaaatgcccatcctgggcacttgatttcattaggattggtggcatttctgccaggaaaagcttcccccc

SEQ ID NO: 46966 - DNA, 201 bp, Homo sapiens
  misc_feature (1)...(201): n = A,T,C or G, or insertion/deletion polymorphism (see Tables 1-2)
cgccagtcagcactactactggctggcagggctgtttcagggacagccagcaggggctgcacagaatgtgttctgttgattagccaaatttacacaggacntgcctgggagattatctctttaggccaggagttgaatttcaagggcaaagtccacagttggcagccgaaaggctgagaacacctggaagaggggaaggat

SEQ ID NO: 46967 - DNA, 201 bp, Homo sapiens
  misc_feature (1)...(201): n = A,T,C or G, or insertion/deletion polymorphism (see Tables 1-2)
tgggctaatgatttccttcaaattccactaataaatcacagattctcagtgctgttattccattgctttattattaaatggcacccttttctagtttttgnttttgcaaaccagtggagtatttaaagtaaaatttcagaatcccttttggagctttcggttgagaccaggctccttggaaccctagtgctttgggagttc

SEQ ID NO: 46968 - DNA, 201 bp, Homo sapiens
aaaatatgcacaaaagtcaggagaactgattcagtatcttggctattatgaataatgatagccattgttcccatctgtataatgaactccatatattcttwatctgcttcaaatattattaacattttgccaattttatctttctcctccattcctggacattatgttatttacccaataatatttcgggaagcatatttg

SEQ ID NO: 46969 - DNA, 201 bp, Homo sapiens
  misc_feature (1)...(201): n = A,T,C or G, or insertion/deletion polymorphism (see Tables 1-2)
ataagactgtgagcagtcccaaaaaatatttatgacaatttttttcccatttggaacatttgtttagcacagtgatagagacctgatgtggtgtttgcgcngggcagattgaatgcactccaaaaggaaaccataaagggtcgagtcgataccacacagaaacacgaggtggtgggatgagtggtttttccacattttaat

SEQ ID NO: 46970 - DNA, 201 bp, Homo sapiens
  misc_feature (1)...(201): n = A,T,C or G, or insertion/deletion polymorphism (see Tables 1-2)
cagcagcaatgtatcccctttccttattctgtttggattgggcccttccctttgccctttacaccttctccctaatccctgtctttaaatttgagacaaangaaaattagctcctttgtattaagtttgggcagctccatcaggacagcacttccctgatgatgccctaaagttagaaacccttccaggagaatctctgtt

SEQ ID NO: 46971 - DNA, 201 bp, Homo sapiens
agataagcatttcagattggtagcatatctgtgacccaagattacaacaaggccatggatcagagccaaatggcctctgaatggcaaggatcatggcaagsaacaggtcagagacaaagcggaggaggttgtcacacaggtaccaatgggattggtagatggggaagaatgagcaaatatccagagttgggagtctcaaag

SEQ ID NO: 46972 - DNA, 201 bp, Homo sapiens
cagctgtctagtttgctgggattcctcccagaggagagtatagtcagcagcaatgtatcccctttccttattctgtttggattgggcccttccctttgccstttacaccttctccctaatccctgtctttaaatttgagacaaacgaaaattagctcctttgtattaagtttgggcagctccatcaggacagcacttccct

SEQ ID NO: 46973 - DNA, 201 bp, Homo sapiens
gcaggagaatcgcttgaacccggtaggtggaggttgcagtgagccaagattgcaccattgcactccagcctgggcaacaagagtgaaactctgtctacacycctgccaaaaaaaaagataaatcttcaccaaaatcatgatgaaaattaatggaacggtaagatttaatttactgcaaaaatccaacagacatgtattgag

SEQ ID NO: 46974 - DNA, 201 bp, Homo sapiens
gacatacctgcttagctaaggaagtcgaattaatatagtctgcatacttcttgggatcaagcactatgtatttttaaattttctgcagattttaggttagyggtaagacattagtgtaatgtttactctgttctaagcattgtgttatactaggcatttttatttcattgttttagtaaatccttacaatgatctgtgagt

SEQ ID NO: 46975 - DNA, 201 bp, Homo sapiens
gagagagggaaaatactagcaaatgtttcaggcaaattgattctaaacctggttctctgactaacttaatctttgactacaaccaaattgtttaacctgcytaagcattattgctagcacttgtgaaatgagatgttagaaaaaaatgaagataatgcaaaatattttgaaaaattatttgctatataaatgtaagaaagc

SEQ ID NO: 46976 - DNA, 201 bp, Homo sapiens
ccaccagcctctttctctgcacatctatgatcagaagcagcaatcagcagacagagcacagatcactgacatttgaaggacaagatcctttttgcccatcstggctccagcaagctgtttcaggaaatgtgtacagctgcctgccatgggggtggtcatgggtagcgtccactacactaagagctgaaattgaccaaaatt

SEQ ID NO: 46977 - DNA, 201 bp, Homo sapiens
tgctgggattacaggcatgagccaccgtgcccagcccaatcctcagtcttaataactgatagaacaaacagaaaatcagcaaagatatagaaggctaaacratactgtcagccaccttgacacctataggaaactccatccaacaatagcacaatacacattcttgtcaaatactcccagaacattctccaaaacagacca

SEQ ID NO: 46978 - DNA, 201 bp, Homo sapiens
cagaatcacaaaaatgacaaatcattacatctggaagatatagcacttgcaaatgtacatgaccctaacaacacagcctcaaaataccaaagcaaaaactracaaaattcaagcaagaaatagacaattcaacagtggtagttggggacttcaacacctcactctttttttttttttttgagatggagtctcactctgtca

SEQ ID NO: 46979 - DNA, 201 bp, Homo sapiens
agaatttaacatttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattccttt

SEQ ID NO: 46980 - DNA, 201 bp, Homo sapiens
tcttctcacctctgcccatttagggccttgctgtgtatgtaacactgaaactgtgtttcacattagcaggcaggcatcaaaccgtctatctggctaacttytgtttaagacattttttaaaataacaaaagcaacaccaggtgttctaaaaacttttgcaaaatggggaatacgtaaggcagaatatgagcatcttctata

SEQ ID NO: 46981 - DNA, 201 bp, Homo sapiens
tttaacatttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattcctttttat

SEQ ID NO: 46982 - DNA, 201 bp, Homo sapiens
agttgggtagcactgggttttttatttatttatattttttatttatatatttaaactaacatccttgagccataaagattctttaaatgatgcatttttaygtacatttagttttacacgaaaagtttatgctcttaatttaaaaaaatggaaagtaagaagtgttggtgagaatgtagagaagttagaatcctcatacat

SEQ ID NO: 46983 - DNA, 201 bp, Homo sapiens
taacatttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattcctttttatct

SEQ ID NO: 46984 - DNA, 201 bp, Homo sapiens
ttttttatttatttatattttttatttatatatttaaactaacatccttgagccataaagattctttaaatgatgcatttttatgtacatttagttttacrcgaaaagtttatgctcttaatttaaaaaaatggaaagtaagaagtgttggtgagaatgtagagaagttagaatcctcatacattgttagtgggagtgtta

SEQ ID NO: 46985 - DNA, 201 bp, Homo sapiens
aacatttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattcctttttatctt

SEQ ID NO: 46986 - DNA, 201 bp, Homo sapiens
ttgcagcattattcacagcagcgagaaggtggaaacaacccaaatgttcactgactgacgaataaacaaaatgtacaaacaatgtgcaaagaaaatgtatraacacagtaatacagactgtggactattcttcagctgtgaaaggaaggaagttctgatgcatactacaatgtagataaaccttgaaaatgctgccctaac

SEQ ID NO: 46987 - DNA, 201 bp, Homo sapiens
atttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattcctttttatcttttt

SEQ ID NO: 46988 - DNA, 201 bp, Homo sapiens
cccccaataaaaattttttttgactttgtttatgctaattatttgcctttcacatgttttacatttttatttaggcaaatattttccttcaaggtgcttcycctcatctcgcttctcggctgtggagttgaattttctgtcatacttggaaaaatcttcttcacttgtcagaatcacaaaaaaaaatttattcatgttttc

SEQ ID NO: 46989 - DNA, 201 bp, Homo sapiens
agagcaggaatgattgaaatcttgtcatttttaaaagtcagagatcaaaggaatagtatttggaagatatttaatataaacagttgaaatttatgtagagtttttttttttttttttttgaagacttcttggctgggcgcggtggctcacacctgtaatcccagcactttgggaggctgagatgggcagatcacgaggcca

SEQ ID NO: 46990 - DNA, 201 bp, Homo sapiens
gagcaggaatgattgaaatcttgtcatttttaaaagtcagagatcaaaggaatagtatttggaagatatttaatataaacagttgaaatttatgtagagtttttttttttttttttttgaagacttcttggctgggcgcggtggctcacacctgtaatcccagcactttgggaggctgagatgggcagatcacgaggccag

SEQ ID NO: 46991 - DNA, 201 bp, Homo sapiens
taagtttacaaaaaaaaagcctttagtgagagaggcagattaaaaatttcacccaagtcttctgattcctaatcctgttttttgtttgttttctcttatcstatatacgatacaaccagatttcttttgttaatgtttggggatagttgcatgaatcccctttgcaaaactttccagtgcttcctatgtgcaattgtattg

SEQ ID NO: 46992 - DNA, 201 bp, Homo sapiens
gtgttctgatggagtaattaaaagatggtaaaggccggacacaatgcaatggctcacacttataatcctaacactttgggaggccagggcaggaggattgrttgaggccaggagtttgaaaccagcctgggcaacataatgagacccccatctctacaaaataaatgaaattaaccaagcatggtaacacatgcctgtagt

SEQ ID NO: 46993 - DNA, 201 bp, Homo sapiens
agcaggaatgattgaaatcttgtcatttttaaaagtcagagatcaaaggaatagtatttggaagatatttaatataaacagttgaaatttatgtagagtttttttttttttttttttgaagacttcttggctgggcgcggtggctcacacctgtaatcccagcactttgggaggctgagatgggcagatcacgaggccagg

SEQ ID NO: 46994 - DNA, 201 bp, Homo sapiens
gatttagcgagcatcatttctgctccatcagccaggggcttaaacagaatttttctttgagactgctctctttctttgctctgttgcacgggctggagtgyagtgatgctatcacacctcactgcagcctctacctcctggactcaagtgatcctcccactgcagcctctggagaagctgagatcatgggcacgaaccacc

SEQ ID NO: 46995 - DNA, 201 bp, Homo sapiens
acagcctcaactccctgggctcaggtgattctcccaccttagccactcgagtagctgggactacaggcatgcatcaccactaggcccacctaatttttttrgtactttttgtagtagagatgtggttttgccatgttgcccaggctggtcttgaactcctgaactcaagtgatcttctattccatcttgagtcagtttcaa

SEQ ID NO: 46996 - DNA, 201 bp, Homo sapiens
gagacagggcagggaggggcattccaggtagaaggatttgcatgcacaaagacaggagtgaagctgtaagtgtagagtgtgcagggaagtcccagttggtygtgtttgttgtccttggcagggtagattgaggagtgtcaagataagactccagagacaggtctcagggctggctcttgaaaggctggatttaccagtgtc

SEQ ID NO: 46997 - DNA, 201 bp, Homo sapiens
ggttggagtggaggaaattaatgaggtagggggttaatactgaagaggaaaagaattgtgatacataggtggggttgaagcaggagcccttgagaggaaaygcagtgagcccctcttcctgttttatccctgagggatccctttgcatagtaaccccaatgcttttctggttggggtttgttttggtaggtagtctttgtg

SEQ ID NO: 46998 - DNA, 201 bp, Homo sapiens
cagcagttgggtccatgtctcacatttttgtccctgtctcctccacacaacattgccacagtccacccccgttccccctccccacctccagtctggtgcartagggatttaaggaggaaatggattacctggatagtagaggaaggaagtttgtggctggcaaattgttattttatttggaaagtctatcccattctctcc

SEQ ID NO: 46999 - DNA, 201 bp, Homo sapiens
ctaggctttataggagtttagagaaaccgtggattttggaatcatggatttggttcaaatccaggttctaaccacttaccaaatagcgagctctcagaacstttccctgtgccctataaaatcttcattatttcatctataaaataataatagtagttatcttacagagtttctctgaggactaaatgagataatatatgt

SEQ ID NO: 47000 - DNA, 201 bp, Homo sapiens
gcctaggctttataggagtttagagaaaccgtggattttggaatcatggatttggttcaaatccaggttctaaccacttaccaaatagcgagctctcagarcgtttccctgtgccctataaaatcttcattatttcatctataaaataataatagtagttatcttacagagtttctctgaggactaaatgagataatatat

SEQ ID NO: 47001 - DNA, 201 bp, Homo sapiens
tccagggttagtattataccagttctagagaaaattttatatctcctagcttatactaagtttacctaattataattatgggtatactctatttaataaaygtaagttatactgtgattatattactgtttgcattcaagtatttatatccctcagttttgtgacttctttttccagtcatataccataccctccacattt

SEQ ID NO: 47002 - DNA, 201 bp, Homo sapiens
tggaagtgttccttgtgtagagttttagtgacctaaaaaaggtcacagtatttcccgacagatccagcagttttcaaaaattaatatattccaattcctgytcccttccaattttatattcctcctaaccttttttgtgatataattctggactctcttaaggcttacttttatatattcttttaggataaagcttatatt

SEQ ID NO: 47003 - DNA, 201 bp, Homo sapiens
agtgttgaatatctcatgtaatttattgaatgctgtactgaaagtgaaaaacagaatggttgtgtgggtattcaacatatggtttccactgaatgtatatwgcttttgcaccatcataaagttgaaaaaaccgaagtcaaatctttataagtcagagactacctgtacagttttattgcggctttatgttaaacgatttgc

SEQ ID NO: 47004 - DNA, 201 bp, Homo sapiens
  misc_feature (1)...(201): n = A,T,C or G, or insertion/deletion polymorphism (see Tables 1-2)
atcctttttgcccatcctggctccagcaagctgtttcaggaaatgtgtacagctgcctgccatgggggtggtcatgggtagcgtccactacactaagagcngaaattgaccaaaattaaccacaatttaggtccaagccttttcctggaagtcacaaaccttcaatagactctagagttccaaaataattacatcagacag

SEQ ID NO: 47005 - DNA, 201 bp, Homo sapiens
tgtcttatccaagtcattgataaaaagggtaaccatgatgagatctagaataaatgggaagagaaaggaatattacagggcaacatccctgatgaacatakatgcaaaaatccttaacagaatactagcaaatagaattcaacagcacactgagtctaataagacaaaggtccagtatccagcatctataagtaacttaaa

SEQ ID NO: 47006 - DNA, 201 bp, Homo sapiens
cagtggtccagagaacccaccccagcattttcttgctgctggcgaccacttccctcttaaacatctagaaagcccttgatgcccaggactaaaggtagagygaccccttttctgagcacatcatattccaaactttgtctctaaactaccagggaaggcatgcatgtctcctaggtaatagccatcaaacttagaggaaag

SEQ ID NO: 47007 - DNA, 201 bp, Homo sapiens
ttagtgttgagagaaaagttctcctcttaggctatgtttagagttcacttcctgctgagtttactggtgtgtgtgcagcagaaatgccagttctggcctgkcatgatggcatgtgcctgtagtcccagctactcagcaggctgaggcgggaggatcgcttggcccaggagttcaagtccagcctaggctgggaaacgtgtc

SEQ ID NO: 47008 - DNA, 201 bp, Homo sapiens
ccacctcctaggctcaagtgatccccccaactcaacctcctgagtagctgggaccacaggcacacgccaacacacctggctaatttttttttttttttttttgagatggagtctcactctgtcgcccaggctggagtgcagtggcacgaccttgggcactgcaagctccacctcccgggttcatgtcattctcctgcctca

SEQ ID NO: 47009 - DNA, 201 bp, Homo sapiens
gctgcagttgacataaaaacaccctactgtactttccatggcatagtggaaggaatgcgaattttgaaatcagtcctggtttgaattgtggctcctccttktactagctgtatgacttgggccttggttttcctgtttggtaaaatagaattggtaacatttacctcataggattgtgttacagtattaaatgaattaaca

SEQ ID NO: 47010 - DNA, 201 bp, Homo sapiens
cacctcctaggctcaagtgatccccccaactcaacctcctgagtagctgggaccacaggcacacgccaacacacctggctaatttttttttttttttttttgagatggagtctcactctgtcgcccaggctggagtgcagtggcacgaccttgggcactgcaagctccacctcccgggttcatgtcattctcctgcctcag

SEQ ID NO: 47011 - DNA, 201 bp, Homo sapiens
gtggaaggaatgcgaattttgaaatcagtcctggtttgaattgtggctcctccttttactagctgtatgacttgggccttggttttcctgtttggtaaaayagaattggtaacatttacctcataggattgtgttacagtattaaatgaattaacataattaacacctgggaacaatgcttggcacacagtagataactgg

SEQ ID NO: 47012 - DNA, 201 bp, Homo sapiens
  misc_feature (1)...(201): n = A,T,C or G, or insertion/deletion polymorphism (see Tables 1-2)
tggatttatatcataccccttagacagtcttccttaaatatcacttctttcagatggaattttgtgaagagttggacagtaattcaagaccccgagttctntaatagcttctatattctgtatttccaactaaaggcagacccatagactttggaaaacaggtaaaaggattgacttcctaccagctagaaattggagcca

SEQ ID NO: 47013 - DNA, 201 bp, Homo sapiens
ggaccaggtgaaggagtgcattcctcccttctcttctctgtcatctcttgggtcacacatgctaggcaggagttgccctttgccttatctgtgcgactgckcatgatctggaaatgactgccatcactcctagataacaccagccctgggcttttgcggaatgaagcccacattacaaatcatgggattatagtgaccagg

SEQ ID NO: 47014 - DNA, 201 bp, Homo sapiens
acctctttgtgtttatggtacttggagttcttttgatcttcttggatgtgtagatttgtttttcctcaaatttataaagttttcagccatttttttctgtccctttctctttctcttctttttctgggactctccttatacatatgttagtatgtttggtggtatctctcaaatctctgaggcttgttcatttttcttcat

SEQ ID NO: 47015 - DNA, 201 bp, Homo sapiens
caattctagagaaacagagttgctggttgtgtaggctaaactaaggccactgtgatgtcattgcttttgtctcctttgacaccctttttttttttttttgwtactgggtcttgttctattgccaaggctggagtacagtggcacagtcaccactcactgcagcctcgacctcttgggctcaagtgatcctcctacctcaga

SEQ ID NO: 47016 - DNA, 201 bp, Homo sapiens
cctctttgtgtttatggtacttggagttcttttgatcttcttggatgtgtagatttgtttttcctcaaatttataaagttttcagccatttttttctgtccctttctctttctcttctttttctgggactctccttatacatatgttagtatgtttggtggtatctctcaaatctctgaggcttgttcatttttcttcatt

SEQ ID NO: 47017 - DNA, 201 bp, Homo sapiens
ctctttgtgtttatggtacttggagttcttttgatcttcttggatgtgtagatttgtttttcctcaaatttataaagttttcagccatttttttctgtccctttctctttctcttctttttctgggactctccttatacatatgttagtatgtttggtggtatctctcaaatctctgaggcttgttcatttttcttcattc

SEQ ID NO: 47018 - DNA, 201 bp, Homo sapiens
agcctaggctttataggagtttagagaaaccgtggattttggaatcatggatttggttcaaatccaggttctaaccacttaccaaatagcgagctctcagwacgtttccctgtgccctataaaatcttcattatttcatctataaaataataatagtagttatcttacagagtttctctgaggactaaatgagataatata

SEQ ID NO: 47019 - DNA, 201 bp, Homo sapiens
cttttgttatacttctgtctatgatatctccctctttttctgcttaccttttccgttatttcaagtaaaactcatctgctattaccagattgtccttattytctttttgcgtgaaattaactagctttattgatttttctaataaaagaaatacatgctcattgaggaatatttggacaataacaaaaaatattaggaaga

SEQ ID NO: 47020 - DNA, 201 bp, Homo sapiens
ggactctccttatacatatgttagtatgtttggtggtatctctcaaatctctgaggcttgttcatttttcttcattctttttcttttcttttcttcaaatygtataatctctattgatctatctatcttccagtttactgattctttttctgtaatctgaaatttgctcttgagcccctctagtgaattttcatttcaatt

SEQ ID NO: 47021 - DNA, 201 bp, Homo sapiens
ttactgtaacctctgcctcccgggttcaagtgattctcctgcctcagcctccagagtagctgggattacaggcatgcaccaccacacctggctagtttttwaaaaaaaaaattttttttgtattttttgtagagatgggcttcgccatgttggccaggctggtcttgaactgctgacctcaggtgatccacccgccttggc

SEQ ID NO: 47022 - DNA, 201 bp, Homo sapiens
tgttaatgggtatcacatctcagttataatttgcattttgttgatgactaataaagttggataccttttcatatatctcttcactgtttgggtatcctctstggtgaagtatctgttctacttgtgccattcttcttttgagttgttttttatttatttgtagaagttcctcatatattctggatatgagttcttggttgg

SEQ ID NO: 47023 - DNA, 201 bp, Homo sapiens
ttactgacctagccaaggctatagaaccattgagggcagtactggaaagaatggggtgtcttcatttctagatttcatgctgtgcacactaaacaaatggkttgtaaagattcaaaacatcgcttaagtcagccaaaaatgtttttctattaatctaaagtttgagtaagtgaaattttgaagacgatggtatctaattga

SEQ ID NO: 47024 - DNA, 201 bp, Homo sapiens
tagataaataacccatgctttcaagaggctcacaatctggcagtcagcagattggctcatggtgagcaatacttatgaacaatggttatgggctatgaagygagccttgggtgccaagggagagagtaatccattctcccaaggagtaggaagaagtcggagaaggctttattaaaaaggtgacatttgagttgggcctat

SEQ ID NO: 47025 - DNA, 201 bp, Homo sapiens
ttaatctggagtcttgctgtttgtgtgcctgatgtgtgaaagcctccagattaacaagcaaaggaacaattaggactattattaggaaagtgaatgactgkgagtagcaaatccttttctaagtcagatggtttccaattcttgctttcaacaaaattgaaggcattgtcagttggtagataattaaaaataatttttgat

SEQ ID NO: 47026 - DNA, 201 bp, Homo sapiens
tccagtttactgattctttttctgtaatctgaaatttgctcttgagcccctctagtgaattttcatttcaattattttcttttcactccataatttgtttygttttataatttatttttattgatattctatattgtcactgttgccatactttaatttttaaaattttgttttctttagttctttgaacatatttacaac

SEQ ID NO: 47027 - DNA, 201 bp, Homo sapiens
ttttattctatcttatttttcaattacgttcacttttctaattcagtaactttttattttaactaatactcagaccatattcagatttccccatagtcttmgtccattcaggatgctataacaaaatactttaggccaggtaatttgtgaacaacaaaaatgtattgctcacagttctggaacctggaaagcccaagattt

SEQ ID NO: 47028 - DNA, 201 bp, Homo sapiens
ttggtgtttggtgtatattagctgaatggatgcatgactgtaagtatgaatggaaggaggaaagatggttgtcctggcttccaggaaccatagttacaatwtcatactgccccccttctcctgctctagcgagaaaagaatcagactcacagcttgacccaggccaacacaggaatagttcaagctcctggcccacactgc

SEQ ID NO: 47029 - DNA, 201 bp, Homo sapiens
tacaaaatattagccggtgtggtggtgcatgcttataatcccagctactcaggaggctgaggcaagaaaatcacttgaacccgggaggtaagaggttgtgktgagccgagattccaccattgtactgcagcctgggcaacaagaatgaaacttcgtctcaaaaaaaaaaaaaaagaaagaaagaaagaaagaaaagaaaga

SEQ ID NO: 47030 - DNA, 201 bp, Homo sapiens
caaaaaatttctcccattatttaggctgtcttttcactttcttgatggtattgcttacagcacaaaagttcttttctttgacatagtacaattcatgtcctttgtgtgtgtgtgtgtgtgtgtgtgtgtgtgtgtgtgtgtgcgcgcgcgcttttggtgttatatctaagaaaccattgcctaatccaatgtcataaagat

SEQ ID NO: 47031 - DNA, 201 bp, Homo sapiens
catggtaacccagaggggagggttctgtttttaccaagtcacaccactttccttcctccatacctgctagggctgagcctcagttgaatgtgagaaaaacrctatgggtgtgatatttgccactctctctgccttgggaccttgagtcatagtctcattcttcatctcaaacagtcttctgtctcattctgtccagctact

SEQ ID NO: 47032 - DNA, 201 bp, Homo sapiens
aatttctcccattatttaggctgtcttttcactttcttgatggtattgcttacagcacaaaagttcttttctttgacatagtacaattcatgtcctttgtgtgtgtgtgtgtgtgtgtgtgtgtgtgtgtgtgtgtgcgcgcgcgcttttggtgttatatctaagaaaccattgcctaatccaatgtcataaagatttact

SEQ ID NO: 47033 - DNA, 201 bp, Homo sapiens
actaatgtgggccaaactggcaccatgcctcccagcccccgggtacgtgggagctgtaggcacacatggtagattggagctggagggatcatttaccagcmcttccctgagctggaagcaggcggggagcagcaagccaattggcagacttgccttttctgccttaaagtactttgtttctgttgctaacaacagacatgg

SEQ ID NO: 47034 - DNA, 201 bp, Homo sapiens
tttctcccattatttaggctgtcttttcactttcttgatggtattgcttacagcacaaaagttcttttctttgacatagtacaattcatgtcctttgtgtgtgtgtgtgtgtgtgtgtgtgtgtgtgtgtgtgtgcgcgcgcgcttttggtgttatatctaagaaaccattgcctaatccaatgtcataaagatttacttc

SEQ ID NO: 47035 - DNA, 201 bp, Homo sapiens
attgatatagcaacatttgtctcccctgggcagggggaaatgaattaggattaccctctgggttgagcttacaagtctgtcttaggatctcttttttaccsaggtagccctcttggctatccaaggtggggtgcctgggtgggggtggcacactggaagctcatagcagctgcttctctccaggcactgtaactcactagc

SEQ ID NO: 47036 - DNA, 201 bp, Homo sapiens
ttcactttcttgatggtattgcttacagcacaaaagttcttttctttgacatagtacaattcatgtcctttgtgtgtgtgtgtgtgtgtgtgtgtgtgtgygtgtgtgtgcgcgcgcgcttttggtgttatatctaagaaaccattgcctaatccaatgtcataaagatttacttctgttttcttccagcgttgcttttgt

SEQ ID NO: 47037 - DNA, 201 bp, Homo sapiens
gaatatctcatgtaatttattgaatgctgtactgaaagtgaaaaacagaatggttgtgtgggtattcaacatatggtttccactgaatgtatattgctttygcaccatcataaagttgaaaaaaccgaagtcaaatctttataagtcagagactacctgtacagttttattgcggctttatgttaaacgatttgccagcct

SEQ ID NO: 47038 - DNA, 201 bp, Homo sapiens
atggtattgcttacagcacaaaagttcttttctttgacatagtacaattcatgtcctttgtgtgtgtgtgtgtgtgtgtgtgtgtgtgtgtgtgtgtgcgygcgcgcttttggtgttatatctaagaaaccattgcctaatccaatgtcataaagatttacttctgttttcttccagcgttgcttttgtaattgtagctct

SEQ ID NO: 47039 - DNA, 201 bp, Homo sapiens
acagtatttttcttctcgtgactggcttatttcatttagtataatgtcgtaaagtttcatccatgttgtagtatattgcggaatgtccatccatttttttwaaaattttttttatactttaagttctagggtacatgtgcacaacgtgcaggtttgttacatatgtatacatgtgccatgttggtgtgctgcacccattaa

SEQ ID NO: 47040 - DNA, 201 bp, Homo sapiens
acttctgttttcttccagcgttgcttttgtaattgtagctcttacatttagggctatactacattttttactttatttttaaatatggtatgaggtggggycctactttattcttttgtatatggatatccagttttctcagcacagtttgttgaaaagactcttctttccccatgaattgtcttggcatccttattgaaa

SEQ ID NO: 47041 - DNA, 201 bp, Homo sapiens
gatggtgagcattttttgatgtgtctgttggctgcataaatgtcttcttttgagaagtgtctgttcatatcctttgcccactttttgatggggttgtttgtttttttcttgtaaatttgttggagttcattgtagattctggatattagccctttgtcagatgagtaggttgcaaaaattttctcccattttgtaggttgc

SEQ ID NO: 47042 - DNA, 201 bp, Homo sapiens
ttgcaaaaattttctcccattttgtaggttgcctgttcactctgatggtagtttcttttgctgtgcagaagctctttagtttaattagatcccatttgtcratttttgcttttgttgccattgcttttggtgttttagatatgaagtccttgcctatgcctatgtcctgaatggtattgcctaagttttcttctagggttt

SEQ ID NO: 47043 - DNA, 201 bp, Homo sapiens
ccccacccacatcatgctgattggtccattttacggagagtcgattggtctgttttacagagagctgattggtcctttttgacagggtgctgattggtgcrtttacaaaccctgagctagacagaaaagttctccacctccccactagattagctagatacagcctgtggactgatgtatttacaaaccctgagctagaca

SEQ ID NO: 47044 - DNA, 201 bp, Homo sapiens
aggctttataggagtttagagaaaccgtggattttggaatcatggatttggttcaaatccaggttctaaccacttaccaaatagcgagctctcagaacgtwtccctgtgccctataaaatcttcattatttcatctataaaataataatagtagttatcttacagagtttctctgaggactaaatgagataatatatgtca

SEQ ID NO: 47045 - DNA, 201 bp, Homo sapiens
gagggcatccctgtcttgtgccggttttcaaagggaatgcttccagtttttgcccattcagtatgatattggctgtgggtttgtcataagtagctcttatwattttgagatacgtcccatcaatacctaatttattgagagtttttagcatgaaaggctgttgaattttgtcaaaggccttttctgcatctattgagatag

SEQ ID NO: 47046 - DNA, 201 bp, Homo sapiens
gctttataggagtttagagaaaccgtggattttggaatcatggatttggttcaaatccaggttctaaccacttaccaaatagcgagctctcagaacgtttmcctgtgccctataaaatcttcattatttcatctataaaataataatagtagttatcttacagagtttctctgaggactaaatgagataatatatgtcagt

SEQ ID NO: 47047 - DNA, 201 bp, Homo sapiens
tcttagttatttcttgccttctgctagcttttgaatgtgtttgctcttgcttttctagttcttttaattgtgatgttagggttttagatcaattttagatmtttcctgctttctcttgtgggcatttagtgctataagtttccctctgcacactgctttaaatgtgtcccagagactctggtatgttgtgtctttgttctc

SEQ ID NO: 47048 - DNA, 201 bp, Homo sapiens
aagtatgttttatcagagactaggattgcaacccctgcctttttttgttctccatttgcttggtagatcttcctccatccctttatgttgagcctatgtgwgtctctgcatgtgagatgggtctcctgaatacagcacactgatgggtcttgactctttatccaatttactagtctgtgtcttttaattggcacatttagc

SEQ ID NO: 47049 - DNA, 201 bp, Homo sapiens
actttcaggtacaccactcagatgtagatttggtcttttcatgtagtcttatatttcttgaaggctttgttcatttctttttactcttttttctctaaacytctcttctcacttcatttcattaatttgatcttcaatcactgataccctttcttccagttgactgaattggctactgaagcttgtgcattcatcacgtag

SEQ ID NO: 47050 - DNA, 201 bp, Homo sapiens
tcccagagtacatgttaattaagtatgcataaatatatctttgagagaatgtggtggcaaatgtattaatttagagattgaaagcttgaggtgtggaaagatataataacaatgcacatactacagttaattgtgagcaaatttatatcctttctgcatattgttgtcacataaactaatcatctcttaattactttgtcc

SEQ ID NO: 47051 - DNA, 201 bp, Homo sapiens
tttttcccccaaagtgccatcatttttcacttatattttgtaacctacttttctgactaatattacttggatatattccacagacagtacatacagagctactctataatgtttaatgctgcatagaattacattgtatggatgaattgttatttagttaacctgacgatggacttttgggttgtttctgttattaatagc

SEQ ID NO: 47052 - DNA, 201 bp, Homo sapiens
  misc_feature (1)...(201): n = A,T,C or G, or insertion/deletion polymorphism (see Tables 1-2)
tgatgggctcaggctcagcctcagagaataggtggattggagcctgtgatgggggctctttcccccaccagagtgggtgaaagcagggaggaacaggcggnaagatactttaggagttgggagggtattaattccacctcttctctccttcctctgtaccccaacattccctgtgagttgtcaagggctggagagataaca

SEQ ID NO: 47053 - DNA, 201 bp, Homo sapiens
gcttgttctgtcagggcctcttcccaccactgtgtcctcgcctcctgtgggctttcacatacaagggcctcaccatccctgaattgccagaatccttgttstgagaacccagtgcctcccagtcagggcccaggaagctgtgggtaagctcttggtttccttctcggccagacacttctgggaaactatctgcattccttt

SEQ ID NO: 47054 - DNA, 201 bp, Homo sapiens
  misc_feature (1)...(201): n = A,T,C or G, or insertion/deletion polymorphism (see Tables 1-2)
tacatacttatgtgattcttacctatcagggaggtcttggggtcatgtgttgtggggcagaggctctgagtctaagaatgggctggtcagccaggggctcnacctcccagtttgttggcttcctcaaggatgccatccttctttgcagctgccaatcttcactggtgtctgtgccctggcagggtatagagcccttctcat

SEQ ID NO: 47055 - DNA, 201 bp, Homo sapiens
gctgggaggatcaagaaaggttttgcagagaatgtagttttcaagctaggccttgaaggatggcctaggaatcagtgagagaagaggtagataagataccrgttaactgcttttacaataagtgtggttggagtgggacagaatttggtcctctttattttttatggatttcaaggttttagcacattcctcatagggtta

SEQ ID NO: 47056 - DNA, 201 bp, Homo sapiens
gcctggccgaggtgttggttcttttaaaaattttccaacttgctttcctgtctcgctgtcactctggaaggcgggggtgaggggtaggaggagagacagtyggctcagtcggctgtgatccatctttggcactggagatgggtgtggcagataccttttgtgaggaaggagcttagaggcagatgagagaatctgcctctt

SEQ ID NO: 47057 - DNA, 201 bp, Homo sapiens
cgccaccacgcccagctaatttttgtatttttagtagaaacagggtttcaccatgttggccaggctggtctcgaactcctgacctcaggtgacccacccgyctcggcctccgtaagtgctgggattacaggcatgagccactgcacctacccatctgtttcttcagcttctcattatctcaccaattctagagaaacagag

SEQ ID NO: 47058 - DNA, 201 bp, Homo sapiens
agtgtgcaccaccatgcccagctaatttttgtattttgtactagagacggggtttcaccgtgttggccaggatggtcttgatctcttgaccttgtgatccrcccacctcggcttccaatagtgctgggattacaggcgtgagccactgtgcctggccgaggtgttggttcttttaaaaattttccaacttgctttcctgtc

SEQ ID NO: 47059 - DNA, 201 bp, Homo sapiens
attaaggttttcagagtccaggtcgtatatgagaaggggaagtgtcatctggattttatggaatctgtattaggaattgccctttccttgcaaaggaaacmgttaatgatgtaatccacttttaaattaaaattattttattattttattttgatatccttcacgtggacacttagtatataacaggaaggcatctttaat

SEQ ID NO: 47060 - DNA, 201 bp, Homo sapiens
ctgctggactgggctgggcctggctttgacatctagtttcagagtcaaatgccccactttctgactctgtctcaatagggtcagatggtaattgggtttcygagagttaggaaggcaggtaggtgtggggaggatctttagcagctgggcttctggatactcttctgtctctgatggggctatgacaggggagtgttaata

SEQ ID NO: 47061 - DNA, 201 bp, Homo sapiens
acagctatttagtggtggggcgggacccgtgatataggcctctccctcctaagacaattttaagacaacagcagcatggaagagagtgtgggcttcgcagyaagtccgtctggctggataacattaggtgataaaccaatctctgagagctgagagaaacttactcagaagcattcagaccatatcaatggttcagctcct

SEQ ID NO: 47062 - DNA, 201 bp, Homo sapiens
ctggaacgctggagccgcccaggtgtcccctggtcatggcactctaggcctatccctgcctttctagcctcattttgcaccatcccatatctaatttcttyccctgtctctgtttccttctctctcacacacacccacactctcacactcactctactattagtatgatatattgctactcacaacactcctgacaccaaa

SEQ ID NO: 47063 - DNA, 201 bp, Homo sapiens
ttgagcagtattcagtattaggaggaggtttgtagtgaagcctgtcagttttatttattattttttagagacgaagtcttgctacctctaggagataacargcgtgaccatagccactgtgacctcgaactcctagcttcaagctatcctcctgcttcaaggcttgtcaattttagaaatgaagatagtttttctgtcagg

SEQ ID NO: 47064 - DNA, 201 bp, Homo sapiens
tctctcacatttgccaatttgccaaactttctggacaccaactggggtttcttacaatttaattcaattttgacactacctggagctagcataatctccayagattaagtggggacaagactgtccccacttcagatgctaatcacaagtcagggccacccatacttttgaccaactcactataaagttggagggatcggt

SEQ ID NO: 47065 - DNA, 201 bp, Homo sapiens
aatttcagatcaattggcttagaacaggaatgtccaatcttttggcttcccggggtcacactggaagaagaatcgcctggggccgcatgtaaaatacactyactctaaggatagctgatgagcttaaaataaatcgcataaaaaatcataatatttttaaaagtttacgaatttgtgttgggccacactcagagccgtcct

SEQ ID NO: 47066 - DNA, 201 bp, Homo sapiens
aaccagtccttctttcccagccaggggaacagtggtaaagctgggtggtaggcatttgcatgggggaggattaggatcagtgtggccactgcaacaggtgrcaaaaaggctggctcagagcggaggcacagcagctgactgcagggtcccatgagcagcaggtgtgtgaccccttttttctaagacgagacgcttatggga

SEQ ID NO: 47067 - DNA, 201 bp, Homo sapiens
atgacaaaagttgagtcctgtgacatcacaacagttgactattgtatcaacagctgtgatgtcaccaacagaggattatgacttcaaggaagaatggaggkggggcgcatagctggcaagaaaccccgtgggaacaaagaaggtattttcgtgcagatcttcacccagaaagcctgagttggcctttcagtggatggtctg

SEQ ID NO: 47068 - DNA, 201 bp, Homo sapiens
gatgtcaccaacagaggattatgacttcaaggaagaatggaggtggggcgcatagctggcaagaaaccccgtgggaacaaagaaggtattttcgtgcagawcttcacccagaaagcctgagttggcctttcagtggatggtctgtcagtggaagccctctccttggttcccattgctccctgtctctttggattaatgatt

SEQ ID NO: 47069 - DNA, 201 bp, Homo sapiens
taggcacagatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagta

SEQ ID NO: 47070 - DNA, 201 bp, Homo sapiens
gcacagatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactg

SEQ ID NO: 47071 - DNA, 201 bp, Homo sapiens
  misc_feature (1)...(201): n = A,T,C or G, or insertion/deletion polymorphism (see Tables 1-2)
ttgtgaaatggggaaagagactggtgctgtatttgggactttttgaggagaaaaacaagtccagtgaagagcaatgtaaattccttttctttatgtgaagngggccaaaaagggttaaaaacccaggatgcaaaagtgggtactgtgccagagttagacagtgatttatactgtacataccagaaactgtataaatcattt

SEQ ID NO: 47072 - DNA, 201 bp, Homo sapiens
cacagatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactgg

SEQ ID NO: 47073 - DNA, 201 bp, Homo sapiens
cccagagtacatgttaattaagtatgcataaatatatctttgagagaatgtggtggcaaatgtattaatttagagattgaaagcttgaggtgtggaaagatataataacaatgcacatactacagttaattgtgagcaaatttatatcctttctgcatattgttgtcacataaactaatcatctcttaattactttgtcct

SEQ ID NO: 47074 - DNA, 201 bp, Homo sapiens
acagatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggt

SEQ ID NO: 47075 - DNA, 201 bp, Homo sapiens
agagtacatgttaattaagtatgcataaatatatctttgagagaatgtggtggcaaatgtattaatttagagattgaaagcttgaggtgtggaaagatataataacaatgcacatactacagttaattgtgagcaaatttatatcctttctgcatattgttgtcacataaactaatcatctcttaattactttgtccttcc

SEQ ID NO: 47076 - DNA, 201 bp, Homo sapiens
agatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtct

SEQ ID NO: 47077 - DNA, 201 bp, Homo sapiens
ttggcaaaggaacagtagactttatcagtttggttcttgccattacttgtgttcgatcttgaccaagttaaattatttccaggatgtatctttttttttcyttttttttttttttttagacggagtctcactctgttgcccaggctggaatgcagtggtgcgatcttggcttactgcaatctctgcctcctgggttcaagg

SEQ ID NO: 47078 - DNA, 201 bp, Homo sapiens
aagagaaccctttttttctgaactttttacaaccatctccaaattataaaacataagacttttttttttagtaaaaatgtatttttttacaagcacagtgkcttgcaccatggaggggagaggaggtgttttgtccttggagctgctggcctgagagaaccttgtcatcgtgggagctgggccattcctacacagtggtct

SEQ ID NO: 47079 - DNA, 201 bp, Homo sapiens
ttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggtt

SEQ ID NO: 47080 - DNA, 201 bp, Homo sapiens
tggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggtta

SEQ ID NO: 47081 - DNA, 201 bp, Homo sapiens
  misc_feature (1)...(201): n = A,T,C or G, or insertion/deletion polymorphism (see Tables 1-2)
gagaagtgacatttgagtgaaggataatttcagatcaattggcttagaacaggaatgtccaatcttttggcttcccggggtcacactggaagaagaatcgnctggggccgcatgtaaaatacactaactctaaggatagctgatgagcttaaaataaatcgcataaaaaatcataatatttttaaaagtttacgaatttgt

SEQ ID NO: 47082 - DNA, 201 bp, Homo sapiens
ggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttat

SEQ ID NO: 47083 - DNA, 201 bp, Homo sapiens
gttgctttgtgttttgttttatgcaggaagttcatatcagatatgttggcaattagagctttcaaactggaaggagccttttggagtaaaatatatatatwtttttctatcagcataagtaattgtggaatatatgtaaactctggagatgatcttttaaaaaaattaccatcaaaagaattttactcaagtcctttaagg

SEQ ID NO: 47084 - DNA, 201 bp, Homo sapiens
gagctgggccattcctacacagtggtctggcaatgacccggtggtggtggaggcctgtgagtgggcactggtaatgggagcagctgtaaaaccctggaggscagccccaggagagtgaccttaccaggaaagttctgggaaacaaaccacagggaggctttacaggaatttttggttgtgcccacaggcaaggcacatgag

SEQ ID NO: 47085 - DNA, 201 bp, Homo sapiens
gaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatt

SEQ ID NO: 47086 - DNA, 201 bp, Homo sapiens
cctttgcgagattgcactaaaagtaacagattagcccaattaaggcctatctagaagtctgggaatcatttgtttaaactggaatttaggatctccatgcwaatatgatagaaataatctgcttaaccctttgttagtagcattagaaataagcccctttttatgggactcttaatgataaaaggtcatagtaattagaat

SEQ ID NO: 47087 - DNA, 201 bp, Homo sapiens
tggggatgggactaaacttagggggtctgccgtgtcccagggactgtgctcattttctgacaggagcaatattattaccgactgtgacagcagctcccackaagcctgcaccttagctgcagatccttagcagggcagagagacaaggctgtatttgtatcaggtttgtcgtctgggttgtgactctcgacttgcccagga

SEQ ID NO: 47088 - DNA, 201 bp, Homo sapiens
atcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataaca

SEQ ID NO: 47089 - DNA, 201 bp, Homo sapiens
ctcagccttcttttctacttgtgtgtgtagttggagctcttcaattttaccatccccacatctgtgaagagggctagcagagacccagtttcaggagctgstgctccttctgttggtatagcagaaagaataatggatttgggttgctagacttgagtcgacggctagattctgttcccatagggcggccacgggcaagta

SEQ ID NO: 47090 - DNA, 201 bp, Homo sapiens
acgggcatctgtttattctcttattacctttcttcagtgaatatgcttaatgttaggggtttgatgaatcaatgagtggatgaagttaagaaattagatgraggccaggcctggtggctaacacctgtaatcccagcactttgggaggccaaattgggaggattgcttgaagccaggagtttgagacctgcctgggcaaca

SEQ ID NO: 47091 - DNA, 201 bp, Homo sapiens
tgaggcaggagaatggtgtgaacctgggaggtggagcttgcagtgagccgagatcgtgccactgcactccagcctgggtgacagagcaagactcggtctcaaaaaaaaaaaaaaaaagaaagtggcgttaagagtcatggggcgtgggtagaggccactttatatcttgtttcagagggccatttaaaattttttttaatt

SEQ ID NO: 47092 - DNA, 201 bp, Homo sapiens
gaggctggctcagtgctgagggaccaggtgaaggagtgcattcctcccttctcttctctgtcatctcttgggtcacacatgctaggcaggagttgcccttygccttatctgtgcgactgctcatgatctggaaatgactgccatcactcctagataacaccagccctgggcttttgcggaatgaagcccacattacaaatc

SEQ ID NO: 47093 - DNA, 201 bp, Homo sapiens
ctgcactccagcctgggagtgacactctgtctcaaaataaataaataaataaaaatttaaaaatttttttaaaaaaaggaaacaaaaacttttcctctctscataaaataatttcttagtaagtcctacaacaacaggatgggttattggcaacatgttacatattgttttggtcaaagaatccatcccaagcagtggttt

SEQ ID NO: 47094 - DNA, 201 bp, Homo sapiens
tcatttgcatatcaaaggttgcctgcctggctctaagagccggggctttctttccagacaagaaacatttttgagctgctttaaaggaaatgaggtacagkggctcacgcctgtaatcccagcactttgggaggccgaggtgggcagatcacaaggtcaagagatcgagactctcctggccaacatggtgaaaccctgtat

SEQ ID NO: 47095 - DNA, 201 bp, Homo sapiens
tttttttttttttttttttgtatttttagtagagacggggtttcactgtgttagccaggctggtctccaaattctgacctcctgatccaccaacctcggcytcccaaagtgctgggattacaggcatgagtcaccatccccggccctatattcaccatgtttttatgtattccataagccctaactccactgtgacctaca

SEQ ID NO: 47096 - DNA, 201 bp, Homo sapiens
tagacaggcaagaggcagagaaccattagtgtgagcatccttagtggaactggaagggaactcagatgactccaaacagataaaagtaatatatgtagtcrctttgaaaaagtataaaacgtggtaagaaaaactgatggaaattctctgacgaggataacttaaggagataactgcctgtccatgcctcggcttgctgtg

SEQ ID NO: 47097 - DNA, 201 bp, Homo sapiens
ctgccaaacattctggctgtgttgttttgcttaaaaagacatgcagtaaactgttttgattcttggtcgtggtgctgtagggcagatgtttctcctataayggaggtgttgtggtcagttggaaggagcggtggacgtgagttcggagaattggattctaatccctgcagtgttactagtttgtggtgggatcttgcgcaa

SEQ ID NO: 47098 - DNA, 201 bp, Homo sapiens
agatatgacagagaccaaaggactaatgtgctctggtatcacttctagagcctcatgccaacctctccagactctggggtctgctgcttatgaaacgctargcaaattacttaacctttcagcctcagcttcttcatccataaaatggagataatggcatctatttcacatagttgtaactaagattacacaagctaaata

SEQ ID NO: 47099 - DNA, 201 bp, Homo sapiens
agtggagacagtgaaggagaaagagtagttgaaatggggccagagttataaaagggacccagacaatggagggccttataagtcattgtaaagattttggyttttactttgagtaatgggagctatggttttgagagttttgaatagatggggtgacaggagccatgatgctggtggggagtacatgtgatgagtgtagct

SEQ ID NO: 47100 - DNA, 201 bp, Homo sapiens
tgaaaaatggttgaggttgaaaaagcagacttaaagggctttctttgaggaggagggttgggaaggaggatgtgggaatgataagtggacagtgaagagayggaaaaagttcttacttttttttctgattattatgcaacaacaaaaaaattgtctttcctgtggctgattgagggagatttcagcctcacgggggcctgt

SEQ ID NO: 47101 - DNA, 201 bp, Homo sapiens
aatgataagtggacagtgaagagatggaaaaagttcttacttttttttctgattattatgcaacaacaaaaaaattgtctttcctgtggctgattgagggrgatttcagcctcacgggggcctgtaaaaacacccacctatcctctgacctcccagcaaaacaaatgttggttcctctccacttgaccaggctcactatcc

SEQ ID NO: 47102 - DNA, 201 bp, Homo sapiens
tggtaaagtgtaactaaccctgtgaaatattaatagtacccacctcacagggttgttaaagggttaaatgacttaatacacatgaagtgcttgtaactttrgctgttataattacatgtttaaaagtctagcagcgtgtctcataataaatgctcctttgcttttccttaggtccccttactgtgggtaacagattaaagc

SEQ ID NO: 47103 - DNA, 201 bp, Homo sapiens
cctagactttgccattgagggcctgggaactagcaaagaagcctctcatcatgcttgagtctctgctccattcccatgggcatttcctctgctttaggagygtcttctctccctgcagtctgactagccaggatatcaggctaaaagcatagatgagggcctggggctgcttgtaggaggtggggagaaatggtgtagccc

SEQ ID NO: 47104 - DNA, 201 bp, Homo sapiens
  misc_feature (1)...(201): n = A,T,C or G, or insertion/deletion polymorphism (see Tables 1-2)
agtcccaaattattctctgatcctgatagacctggcccagagagagcagttggtggggaggctggtgagtaggcatctgtgtttctaacctagtgcgcccntgtgaggttctcagcagtgccagctcaagatgcctgaattcccaggccacttctgagaatggcagctgcactcttggagaaatgtgactaagggtccctg

SEQ ID NO: 47105 - DNA, 201 bp, Homo sapiens
cgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaa

SEQ ID NO: 47106 - DNA, 201 bp, Homo sapiens
cctccgtattccaggccaggggtttcttggggtctcttaagctgtaacacatggagttaaacattaagtgggaaagcagtttctactacctgccacagacmccctcttggcacttttggaggtcatctggaagatgttcaaggtgcttttggctgcctatagaaacttggcttaccggcattgtcgtctttgcagggctct

SEQ ID NO: 47107 - DNA, 201 bp, Homo sapiens
caactacatttctctttcttagtaagttggctctgtgttctcatatacaactgcatgatagcatttcagagcagtgagtctaccctcctgaaagcagaaaytcagggaaagaaagaatatgtttttcatcatgtttttttaacatgtttcagtttctggtcatgccacaaatcttttgccttttctccaagggcctgccct

SEQ ID NO: 47108 - DNA, 201 bp, Homo sapiens
gggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaat

SEQ ID NO: 47109 - DNA, 201 bp, Homo sapiens
acatatagcaatatgatatgccaagcactttacttggcactgggctgatacaggtagagagtatctcactagagccagtgtgcgtagatgccctgggggcragattgactttatcatcatcatcatcatcaccatcactaatgttatgctattaatatagacttaaatttatagggccaagcatggtggctcatgcctgta

SEQ ID NO: 47110 - DNA, 201 bp, Homo sapiens
ggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaatg

SEQ ID NO: 47111 - DNA, 201 bp, Homo sapiens
gggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaatga

SEQ ID NO: 47112 - DNA, 201 bp, Homo sapiens
atttgttatgttgagcatttttttcatatatttcgtggctatttgtatatcttcttttcagaaatgtttattcatatcatttgctcggtttttgatgggaktgtttttttcttgctgaattatttgagttccttgcagattctaggtatttgttgtttgtcagatgcataatttgcaaatattttctcccattctgcgggt

SEQ ID NO: 47113 - DNA, 201 bp, Homo sapiens
aagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaatgaccc

SEQ ID NO: 47114 - DNA, 201 bp, Homo sapiens
tgttatgttgagcatttttttcatatatttcgtggctatttgtatatcttcttttcagaaatgtttattcatatcatttgctcggtttttgatgggagtgwttttttcttgctgaattatttgagttccttgcagattctaggtatttgttgtttgtcagatgcataatttgcaaatattttctcccattctgcgggttgt

SEQ ID NO: 47115 - DNA, 201 bp, Homo sapiens
ctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaatgaccccaa

SEQ ID NO: 47116 - DNA, 201 bp, Homo sapiens
agtcataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggt

SEQ ID NO: 47117 - DNA, 201 bp, Homo sapiens
gaagctaaggcaggaggattcttgagcctgggagatggaggtagcagtgagccaagattgtactgcacttcagcttgggcatagactgaaaccctgtcttaaaaaaaaaaaaaaatcaggtctggatgtagatgagacttttggggcgcaggttcattccttgtgtgcagctccttaagtactgtttctcttgctgtgaag

SEQ ID NO: 47118 - DNA, 201 bp, Homo sapiens
gtcataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggta

SEQ ID NO: 47119 - DNA, 201 bp, Homo sapiens
tcagagaggatttacaggacccactcataagattcttaggaggccttttgtctgtctgtctgttctatgaggcaacactttaagtaatttaaaaaaaaaawttttttttttgagacagggtctcactctgtcacccaggctggagtgcagtggtgtgatctcggctcactgcagcctctgccaaccaggttcaagtgattc

SEQ ID NO: 47120 - DNA, 201 bp, Homo sapiens
tcataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggtat

SEQ ID NO: 47121 - DNA, 201 bp, Homo sapiens
  misc_feature (1)...(201): n = A,T,C or G, or insertion/deletion polymorphism (see Tables 1-2)
aatcacatctcatgttttgttctctcagctaaaacaaagtggtgatcaataattactgtcaatgttattagggagcctgctattggaacttggaagattancagtagcagaaaaactgaagtgggaatggaaagacgtgaaagtagaacttagcctgggctagttctccagagtcttgagtctggggaggaactgcccttt

SEQ ID NO: 47122 - DNA, 201 bp, Homo sapiens
ttgccatgttgaccaggctggtctcaaactcctgacctcaggtgatccacccgcctcagcctcccaaagtgctggaattataggcatgagccaccgtacctggccagtttttgggggcttaacaaagggtttttcagtctcactttagattttttttaaacagatttattgagggacaattaaagtacaataaattatata

SEQ ID NO: 47123 - DNA, 201 bp, Homo sapiens
cattttgggaaaatgtcagaagatgagaggatggatcaaaactgctttaacactgaaggcagaaagaggagttaagagaccaaagaagtagcagtagcagyagggatggggaggagggggacacatctgagagatgttaggaagtagaattgataggacatagtcatcaagtagatcaatgtgtttggggagagggctgga

SEQ ID NO: 47124 - DNA, 201 bp, Homo sapiens
gaggaattagccactagaatgtgcccattagtggctttgaggggttacaacctgtcagtggaatctgaagcccgggaactgcctctctcccagggcttttyggagttggaacagcctgactgttctagcactgactgctcccttatttggacagtaaattttcagggtgagattggacttctcttttgtcttgggagagtt

SEQ ID NO: 47125 - DNA, 201 bp, Homo sapiens
cataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggtatc

SEQ ID NO: 47126 - DNA, 201 bp, Homo sapiens
  misc_feature (1)...(201): n = A,T,C or G, or insertion/deletion polymorphism (see Tables 1-2)
cacagaggtggaaagtatccagttgactgacagttttaaatcctatctcagtaccttgttggagtggctccgtgagtctgaggtcaaagcggaaggttgcnggaaagagtccacttttgaaatcttttctttaaaaaaatgttgctaaacgttcagttataagataaatcctgggaatctaatgtacagcatagtgactat

SEQ ID NO: 47127 - DNA, 201 bp, Homo sapiens
ataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggtatct

SEQ ID NO: 47128 - DNA, 201 bp, Homo sapiens
cgggaggcggagcttgcagtgagccgagatcgcgccactgcactccagcctgggcgagagagggagactctgtctcaaaaaaacaaacaaacaaacaaacaaaaaaaaaaacacgttagtgtttatctaaccctatgccaagcctggtagtagatatacaatacaactgagggaaagtgataacctgaacttagaacatat

SEQ ID NO: 47129 - DNA, 201 bp, Homo sapiens
ggttaaaaagaaagcaaccagggcagggtgcaatggctcaggcctgtaatcccagcactttaggaggctgaagtgggtggattacttgaggtcaggagttmaagaccagcctggccaacatggtgaaaccttgtctctaaatacaaaattagccgggtgtggtggccggtgcctgtaatcccagctacttgggaggctgag

SEQ ID NO: 47130 - DNA, 201 bp, Homo sapiens
aaatacaaaaattagccgagcgtggcggtgcgtgtctgtggtcccagctaaacggtgggctgagatgggaggattgcttgatcctgggaggtcaaggctgragggagccgagattgtgtcactacactccagcctgagcaacagagtgagcccctgagtgaaaataacaacaacaacaaaagaaattggatgggaaattag

SEQ ID NO: 47131 - DNA, 201 bp, Homo sapiens
atccagatatacttcattttggccaatgtgatggaggataccaatcagagggagagaactactgtttgtaaactgttcagcttccgtgatggtggtgttcrcctaggctgtggtgcaccttgacattggaaatatgcttgatgtgtcgtttgtgttgtcactcacacccactctccaaggcacttaaaaagatttatttag

SEQ ID NO: 47132 - DNA, 201 bp, Homo sapiens
aaaattaaaaaagtagccaggcgtggtggtgcatgcctgtagtcccagctacttcagaggctgaggcaggagggttgtttgagcccaggagtttgatgatrtagtgagctatgattgcaccaatgcattccagcttgggcaatggagcaagatcctgtctctaaaagaaatttaagaagaataataaataaacttgaaaaa

SEQ ID NO: 47133 - DNA, 201 bp, Homo sapiens
ccatcttaacaatattaaattttctgatccatgaatatggtatgtcttttcattttttatgtctaatttctttcaatgatgttttataatttacagtatayatgtcttgcattccttttatttatttctaagtgatttattatttttgctgctattgttaatagaattattttcttaatttcattttcagattgttcgttg

SEQ ID NO: 47134 - DNA, 201 bp, Homo sapiens
tcattttttatgtctaatttctttcaatgatgttttataatttacagtatacatgtcttgcattccttttatttatttctaagtgatttattatttttgcygctattgttaatagaattattttcttaatttcattttcagattgttcgttgttagtatatagaaataaaattgatttttttttctttttggaggcagagt

SEQ ID NO: 47135 - DNA, 201 bp, Homo sapiens
atgtatttgtcactatttctggtccctggagggctggggtagatctcaggatatgaggctcagacttggttgaagccacatcaagagctgtggtcctggtsggtcagcgttattttctgcggcttatcacccaggctaggcgtgtgggagcatgggtgggtaggacagggaagaaaaacagaagaccagatagttctgtgg

SEQ ID NO: 47136 - DNA, 201 bp, Homo sapiens
gagcatgggtgggtaggacagggaagaaaaacagaagaccagatagttctgtggaaactgaataaataagtgaaaaagttggccaggcactgtggcactcrcctgtaatcccagcactctgggagcccatggcaggtggatctcttgagctcaggagtttgagaccagcctgggcaacatggtaaacccctatctctacaa

SEQ ID NO: 47137 - DNA, 201 bp, Homo sapiens
tgcctgcaatcccagcactttgggaggccaaggcaggaggatcactggaggccaggacttcaagacctatctgggcaacatagtgagacccccatctgtgaaaaaaaaaaaaaaattagctggacctggtggcatgaacctgtagtcccagctattcatgaggctaaggtgggaagatggcttgagcccaggatttttggg

SEQ ID NO: 47138 - DNA, 201 bp, Homo sapiens
tctggtttggggctattttgactgataatgcatagtaagactttgtgtggacacatgttttcatttctcttgggaatacagacttgagccgccgcacccasaccagatgtatgattcataagtattttctcccaggctgtgtcatgtatttcattttcttagtggtgtaatttgaagtactaacatttaaagttttgatga

SEQ ID NO: 47139 - DNA, 201 bp, Homo sapiens
ttttggttccatatgaattttagaattgttttttctaatattttcgaaaatgatgttagtatttggataggaattgcattgaatctgtagattgctttggrtagtatgctcattttcatgatattgattctttgatttcatgagcatggggtgtatttctatttgtttgtgtcacctgtggtttctttcagcagcgttttg

SEQ ID NO: 47140 - DNA, 201 bp, Homo sapiens
agagaggaaggagaggaagaagaggaaggagaggaagagaagaaagaatgaaagaaagaaaagaaaggagggagggaggaaggaaggagagagagagaaaragaaagaaagaaaaagagagagaaagatgcttccattatgccatattcttctccagctaccatcccatttctttgttccttttttaggaaaactctaaaa

SEQ ID NO: 47141 - DNA, 201 bp, Homo sapiens
tttctaatattttcgaaaatgatgttagtatttggataggaattgcattgaatctgtagattgctttgggtagtatgctcattttcatgatattgattctytgatttcatgagcatggggtgtatttctatttgtttgtgtcacctgtggtttctttcagcagcgttttgtagttctccttgtagtgctctttcaccttct

SEQ ID NO: 47142 - DNA, 201 bp, Homo sapiens
  misc_feature (1)...(201): n = A,T,C or G, or insertion/deletion polymorphism (see Tables 1-2)
cagccaatgctgttcctgtatttctcacctccttatgcaagactaacatcccagagtggaagaaagtcctcccggatgagtgagtaggcagaggcctaganacacttgccctcctctttcccttctctcaaacctgacctaagaaggcctggggaacagctgtgttgcccagaacagttcttccaaaattctgccccccaa

SEQ ID NO: 47143 - DNA, 201 bp, Homo sapiens
taatgagaacagatgaaagttagttgtcagggttctatgttttggaggagatgcgttggaagaggtctttaattgtgaaatggggaaagagactggtgctstatttgggactttttgaggagaaaaacaagtccagtgaagagcaatgtaaattccttttctttatgtgaagagggccaaaaagggttaaaaacccaggat

SEQ ID NO: 47144 - DNA, 201 bp, Homo sapiens
ggagccccagacaaggtttaggacgtgcaggcttatggcaaatcttgggccaaatggaggcctttggagcttttggagcgcccaagggctcagtcttcagyctgtttcttgtctctgtcttcacttttcttaggtgattccctggctttgaagtactagcatttatggaatgtttactggctgccagaggctgttgtaagg

SEQ ID NO: 47145 - DNA, 201 bp, Homo sapiens
  misc_feature (1)...(201): n = A,T,C or G, or insertion/deletion polymorphism (see Tables 1-2)
aacagggaaatagactgtcagtattgacagaaaaataaactattgatatgagtttttaatgacttctatcttcacaagggtaaattcactaatgagaacanatgaaagttagttgtcagggttctatgttttggaggagatgcgttggaagaggtctttaattgtgaaatggggaaagagactggtgctgtatttgggact

SEQ ID NO: 47146 - DNA, 201 bp, Homo sapiens
gggaggcggagcttgcagtgagccgagatcgcgccactgcactccagcctgggcgagagagggagactctgtctcaaaaaaacaaacaaacaaacaaacaaaaaaaaaaacacgttagtgtttatctaaccctatgccaagcctggtagtagatatacaatacaactgagggaaagtgataacctgaacttagaacatata

SEQ ID NO: 47147 - DNA, 201 bp, Homo sapiens
agtgcctgtgcgtatacacacacccctttcctaactggtttttccagttaggttggggctgggggagtgctgtatgtgtggttaagaccaaaggagttatggggaggagtgaaaggttgtggagaggagtgggaggttgtagggaggagtgggaggttgtggggaggagtgggagcagggcccagaggggctggattcttc

SEQ ID NO: 47148 - DNA, 201 bp, Homo sapiens
gcctcagcctcccgagtagctgggattacaggtgtgtgccaccacgcccggctaatttttgtatttttagtagggacggggtttaccatgttggccaggcyggtctcgaacttctgacctcaggtgatccacccgcctcatcctccctaagtgctgggattacaggcgtgagccaccgcgcctggccgaagcttctttcat

SEQ ID NO: 47149 - DNA, 201 bp, Homo sapiens
tgaggcaggataattgcttgaactcggaagacggaggttgcagtaagccaagatcgctccactgcactcctacctgggcgacacagcgagactccgtctcaaaaaaaaaaaaaaagatttaccctctaattaggactcttttcaaacaggcttcccctgagtttgcattgccagattgattgggtgagaacaggaaattgg

SEQ ID NO: 47150 - DNA, 201 bp, Homo sapiens
ggaggcggagcttgcagtgagccgagatcgcgccactgcactccagcctgggcgagagagggagactctgtctcaaaaaaacaaacaaacaaacaaacaaaaaaaaaaacacgttagtgtttatctaaccctatgccaagcctggtagtagatatacaatacaactgagggaaagtgataacctgaacttagaacatataa

SEQ ID NO: 47151 - DNA, 201 bp, Homo sapiens
  misc_feature (1)...(201): n = A,T,C or G, or insertion/deletion polymorphism (see Tables 1-2)
gttataaccaccactccgatcaagatgtggagcatttctggcatctcagaaggtcacctgatgcctcttcccagacagtatccacattcctatcccaattnctcttctgttatcatttgttttttcttttctcttatttacttgtttatttactatttttgtaaagacaaagtcttgctatgtttcccaggctggtctcaa

SEQ ID NO: 47152 - DNA, 201 bp, Homo sapiens
gggatgagaggtcagcgcatatggagagaggcagagagtagatcagggctggggagagggcagccagggccttgtgggtatgggatccaattcagtgtgaggcctgcctggcccagctttggtggtcagagcccagagcccctgtgttctccatgggagcagttaggagggccaggctgcaggatctcccagcccagcagg

SEQ ID NO: 47153 - DNA, 201 bp, Homo sapiens
gaggcggagcttgcagtgagccgagatcgcgccactgcactccagcctgggcgagagagggagactctgtctcaaaaaaacaaacaaacaaacaaacaaaaaaaaaaacacgttagtgtttatctaaccctatgccaagcctggtagtagatatacaatacaactgagggaaagtgataacctgaacttagaacatataat

SEQ ID NO: 47154 - DNA, 201 bp, Homo sapiens
tataccaaaatatatatgaatactttaaaacgaattaaaaaatattcacaaaatactaaatatttgatctactttaatctcctgttattgtttagtttgtccccccctatgtatttaaactattacagaaatgctatggtgaatatccttatacccatattttagtgcagttccttgattattttggggattcctagaagt

SEQ ID NO: 47155 - DNA, 201 bp, Homo sapiens
cctgtgttctccatgggagcagttaggagggccaggctgcaggatctcccagcccagcaggctggccagtaggttatggcctctgctgtcagaaacctttyaggattggctcgggagcagaggtccggaagactggttccatcacccaggcccagtaattcttgtcccatagctcaggaggacccccgcaaaattcccact

SEQ ID NO: 47156 - DNA, 201 bp, Homo sapiens
gagtgcctgtttccagccattcttgccaaactaaaaagaatgaagataatcggtatttgcaaatctgataagataaaaatggtattgcatttctgttttartttccatttcttggattgctatggagcttgaatattttctcatatatttaatggccgtttaatttctatttcttttatgatttacatgtttttgttattt

SEQ ID NO: 47157 - DNA, 201 bp, Homo sapiens
  misc_feature (1)...(201): n = A,T,C or G, or insertion/deletion polymorphism (see Tables 1-2)
gagggccaggctgcaggatctcccagcccagcaggctggccagtaggttatggcctctgctgtcagaaaccttttaggattggctcgggagcagaggtccngaagactggttccatcacccaggcccagtaattcttgtcccatagctcaggaggacccccgcaaaattcccacttagtcttctttttccactcagatgag

SEQ ID NO: 47158 - DNA, 201 bp, Homo sapiens
gcatcagaacaaaagatccagaagccaggtgggcagttaaggaagatgccccaactgcagcccataccccagttctactcagccacccaagaggcagccartgctgttcctgtatttctcacctccttatgcaagactaacatcccagagtggaagaaagtcctcccggatgagtgagtaggcagaggcctagaaacactt

SEQ ID NO: 47159 - DNA, 201 bp, Homo sapiens
gtgatgtattgttattaactatagttgccatgatgtgcagtagatctcttgaacttatttattcctcctatctctctgaaattttgtgttctttgaccaayatcaccccaatcccttcatcccctagcctctggtaaaatggttattttaccctctgtttctatgagttcaacttttctagattcggcatataagtgagat

SEQ ID NO: 47160 - DNA, 201 bp, Homo sapiens
tgtcactccgcacttctcccaccagcctgtctctcactccgccttccctgcttgtcgccagccagcctggcctccctcttcttcctctcacactcaacccytctctctctgccattgcctctgccaggaatgtgctttctccagctcttcacgtggctgctggctccttctcatttctcaggctctgctcaagtaggacct

SEQ ID NO: 47161 - DNA, 201 bp, Homo sapiens
ttttgtgtctgtgagctcctttaatagaaaactacagaatagaaattatttccaactttcaactttaaattggttcttttaggccaggcactgtggctcaygtctgtaatctcaacactttgggaggccgacgcaggtggatcacttgaggtcaggagtttgagatcagcctggccaacatggtgaaaccctgtctctagt

SEQ ID NO: 47162 - DNA, 201 bp, Homo sapiens
tgaactcctgggctcaagtgatccacctgccttggcctcccaaagtgttggaattacaggcatgaaccacagcacccagccttattggtcttttcttttcttttttttttttgagatggagactccctctgtcacccaggctggagtacagtggggcgatctcagctcactgcaacctctgcctcttggattcaagcaatt

SEQ ID NO: 47163 - DNA, 201 bp, Homo sapiens
caggaggtctgtccagacacctgcatggagcccctcccctgcccagcttgctctggtacataaccctgcttattattttatttttttattcgagacggagtttcgctcttgttacagaggctggagtgcaatggcgctatctcggctcactgcaacctccgcctcctgggttcaagcgattctcctgcctcagcctcccaa

SEQ ID NO: 47164 - DNA, 201 bp, Homo sapiens
caccacgttggtcaggctggtgttgaactccttacctcaggctatccacccaccttggcctcccaaagtgctgggattacaggtgtgagccaccgcgccckgcctgtagtattctcttcacctttgtatccctagtgcttagcagtgactgtcttattttaagtgttcagtgaatatttgcagaatggtgcaacccttggg

SEQ ID NO: 47165 - DNA, 201 bp, Homo sapiens
aaggagttcggaaagaaagttactgccttgctgcttccagggctgctatttcccgcctgtcccatctcacatctgcccctggaagatgctgctattctacmaggccttatgtttgcattctgagcctgacacttaaaaatgcacccaaggaagcagcttgttaaggaattatgtggagtggcctcggcgcctgagctgcat

SEQ ID NO: 47166 - DNA, 201 bp, Homo sapiens
cattggcatggtttcctggaatcggatttgcctccctcttggctttgtctaatgcctggctctgctttatacagcagcccagtctttactggactagggcwctggggatgttcctgtcagggatcagtaacctcagagggggcttctgcagtgtcagtattctctctgtgttcacttgccactgctccttagagagttcat

SEQ ID NO: 47167 - DNA, 201 bp, Homo sapiens
cttgtaggagctgaggctgtgggaataaagtgtgggccctgattctgaagggacttgattcagtcctgaagagaaaccgtgtatttttggtttctagacactctgtaatttatttaatcagacctttattgagcacatttaggctgtcttcagtctctttctgttaaaatataacagtaattatccacgaataaacataat

SEQ ID NO: 47168 - DNA, 201 bp, Homo sapiens
ttgtaggagctgaggctgtgggaataaagtgtgggccctgattctgaagggacttgattcagtcctgaagagaaaccgtgtatttttggtttctagacactctgtaatttatttaatcagacctttattgagcacatttaggctgtcttcagtctctttctgttaaaatataacagtaattatccacgaataaacataatt

SEQ ID NO: 47169 - DNA, 201 bp, Homo sapiens
cgcccccagctatcgcacgctggagctggagctgctggagtggcaggagcgggagctttttgagtactttgtggtggtgtccctcaagaagaagccatcgsgaaacacctacctccccgaagtctcctaccagtttcccaaggtgaggccttctctctccccaccttgcccatattccccctcttccatcctctatccgcc

SEQ ID NO: 47170 - DNA, 201 bp, Homo sapiens
agagctggttcagctgtttggggcccttgggcattaggaacgggagaggcatcaatttacctgtggagggtagagccctgccaggaaatggccacataggmgggaggagcagacagggaagaaaggtctgggatgggttccttcagactttgggctgtgaggccctgagcagggaggtgggtgtgggaatcggcttctgca

SEQ ID NO: 47171 - DNA, 201 bp, Homo sapiens
  misc_feature (1)...(201): n = A,T,C or G, or insertion/deletion polymorphism (see Tables 1-2)
ctgggcctttgacactttggctacgtcggggacttccacatcatccacatgaaggcagaggaacccagtggttctaagacgcatttgtatccagctttggnggaagagggaggtctggtcaaggaaaactggcgggggtgggcagatgggaccctgtgtaactgtcaaggtgtgtatttgaaggactgtacccttaatttg

SEQ ID NO: 47172 - DNA, 201 bp, Homo sapiens
agcccagcgccttcctcagggggcatggcagcaggaaggagagctcagcagtgctgagccggatccagaaaattgaacaggtcctgaaggagcagccgggycgggggctcccccagctccccagcagctgctacagcgtggaccgggggaaaaggaagactggaaccttgggctccttggaggagccggcagggggcgcga

SEQ ID NO: 47173 - DNA, 201 bp, Homo sapiens
tcctgggtgtgtaataatacaagatttcctaataacacaggatttcctccccacctctcaaagctgcttgtgttcagttcctgccacttgacagacagctccccatgtcttatggctgctgcatcaggcagaatgatcaaagaaagggcacagggagccatggacaaggtagggagagaaagacaattgctttggaaagtc

SEQ ID NO: 47174 - DNA, 201 bp, Homo sapiens
tgaggaaggggcaagagcactgaccggggacagtgtgaggaatgctgagccagccagcgagggtcctgtggagggtgtcccctggagaaggcaactgcagtggcccagggctgggcaatgggagggctggggagaaggatgtgatgggggcactgaggtgcagagaggagagtgggtgaggaaggctggccagcccacacc

SEQ ID NO: 47175 - DNA, 201 bp, Homo sapiens
tgtagcaggggtcgctgcctgcctcccccttgcccagagcacgccattcccggggccagcagctggcccccggggcgtcttgctgacccgtaccggtaccsgcgcccacagcctgggcatccgggagaagatatcagcatgggaaggtcgccgagaggcgtcgcccaggatgagcatgtgtggagagaagcgggagggctc

SEQ ID NO: 47176 - DNA, 201 bp, Homo sapiens
  misc_feature (1)...(201): n = A,T,C or G, or insertion/deletion polymorphism (see Tables 1-2)
tgacagcgtaagtttcttgatatttgtcagtttgggaatttttatttagtagtgcaacattaagagaagtttgactgtccagcttgtttcatgcctttttnttttaaaatcacagttactgttgggagtccattttgacagattttgatgaaaacagtatcaacaagcattgtaatttcactcaatatggaatattctggt

SEQ ID NO: 47177 - DNA, 201 bp, Homo sapiens
gagaatagtgcccgggcacggtcagctctgctccaggctccctctgctctgggtcagggccccatagggccagaactctgcctctgcacaccaaacccttkctggctgatgaggaccttggtctcactctagcgtcttttctaccccaggtagtttaggaaggaaaacccaaagacatgtggcaaccccaaagatactttc

SEQ ID NO: 47178 - DNA, 201 bp, Homo sapiens
tgctccaggctccctctgctctgggtcagggccccatagggccagaactctgcctctgcacaccaaaccctttctggctgatgaggaccttggtctcactstagcgtcttttctaccccaggtagtttaggaaggaaaacccaaagacatgtggcaaccccaaagatactttctgctgacagaaaactaattattcctcct

SEQ ID NO: 47179 - DNA, 201 bp, Homo sapiens
tgtgacgtgtggccagcaggtttggagactgaaatagccccatctgcatttgcttagcagcctgcacgaggggccagcacctgctgctctgctccctcccsactcggacttgccaggccctccaggcctctgagtcctgctggagaaggcactgcagcctgcatgggggctccgggcctgggagctctcagtgcatgtctc

SEQ ID NO: 47180 - DNA, 201 bp, Homo sapiens
cttccccactctgtatgtaatgcttgtgagaggacaggaggggtcactggggagggggaccactggtggcccagtttgctggtgtggtcacctcagaagtkagggaaagcctgttgccctgagcatgggtagaaagctggcttcagacccctttgctcttctgtggaactccccacccacctttcttgttcagttgaacag

SEQ ID NO: 47181 - DNA, 201 bp, Homo sapiens
gcgaatcagcaagtgttcaggagcctaagcaggcgccggagaccagtgctggagtggggctgtgcgtagggagatggaagactaggtggaaaggtagcacmcctgtgtgggtgagggagcagggtttgggagcacacagatggcaggattgagaaccctgtggagggcttggcctgaggggagagggagggatatttcttc

SEQ ID NO: 47182 - DNA, 201 bp, Homo sapiens
tcgcccttcccagccccagggaagaccatcaaagtgaagacattcctgccaggtgctggcaatgaggtagggatttctgcaccctcttctctcgggctacrggctggggtggcaggaggaccatgctggccaaggtcgtagtctttgggggttgcagagcacggtccctccttgctcaaccatgtctgtgtaccccatcac

SEQ ID NO: 47183 - DNA, 201 bp, Homo sapiens
cagaggtgtactgtgtcatcagccgccttggctgcttcggcttgttttccaaggtaagaggctctggcaggcttccctccccgtcccccagctgacagctyccacaggagtatctgcagccagcttagatgagaaaaccacctgtgactgtgagcgagcgggagacagaatgcaggaacaagtaccagtgagctctctgac

SEQ ID NO: 47184 - DNA, 201 bp, Homo sapiens
taacagtaattatccacgaataaacataatttaatgttaattttgataatgccactgttttggtgggagaggcagataagctagtagtcttcagacagggmatattttctagatccttgactttctatgtcccctttccaaaggctgatctgtctgagaattcagttgcactcaaggtgtttcctttctcaatcactcttc

SEQ ID NO: 47185 - DNA, 201 bp, Homo sapiens
ttaagcatcaaatggtctaggttctgtggtgacattattaataccctttttagttggattgattagttggttggttttattagttcattcatttaaaaatytattaattgtacgtggtacacagccctaagctagaattcagagttaagacatagttctttctctaaagaatattacagctagcaggagaattaagctgaa

SEQ ID NO: 47186 - DNA, 201 bp, Homo sapiens
aggcaggagaatcccttgaacccaggaggcggaggttgtggtgagccgagatcacgccattgcactccagcctgggcaacaagagcaaaactctgtccccmaaaaaaaaaaaaaaaacttcatgggtttcttatgaatcattttataatccattataatagcaaaaggcacacatacaaatcacttcaagataagcccctt

SEQ ID NO: 47187 - DNA, 201 bp, Homo sapiens
ggcaggagaatcccttgaacccaggaggcggaggttgtggtgagccgagatcacgccattgcactccagcctgggcaacaagagcaaaactctgtcccccmaaaaaaaaaaaaaaacttcatgggtttcttatgaatcattttataatccattataatagcaaaaggcacacatacaaatcacttcaagataagccccttg

SEQ ID NO: 47188 - DNA, 201 bp, Homo sapiens
cttactgtcttcagagaggatttacaggacccactcataagattcttaggaggccttttgtctgtctgtctgttctatgaggcaacactttaagtaatttwaaaaaaaaatttttttttttgagacagggtctcactctgtcacccaggctggagtgcagtggtgtgatctcggctcactgcagcctctgccaaccaggtt

SEQ ID NO: 47189 - DNA, 201 bp, Homo sapiens
ttccagacatctactgccaaccacccacctcaaaaaaaaaatttaatggcataaaacaacatgttcttatgctcccagactccatggattaggaattcagwcagagcactgcagggatggcttgcccctgctccatgatgtctgccttggctaaaaagacttcaaggctggctgggcgcagtggctcacgcttgtaatccc

SEQ ID NO: 47190 - DNA, 201 bp, Homo sapiens
cagggattggggcgtgttcctgtgagacagtgccagagggaatatttattatgcactttaactctcactttctgtctatgtgcatgcgcacacatacacaygatgctttttcttttcttgtttcttttttttttttttttaatttttgagacaggatctcactttgttgcccaggctagagtgccatggtgtaaccatggc

SEQ ID NO: 47191 - DNA, 201 bp, Homo sapiens
ctgactggggaagatggcagcagacgctttggctactgcaggcgcttactggtgagtgaggccattcggtcctcaggccagcaggcaggggataggccagggtgtgtgtgtgtgtgtgtgtgtgtgtgtgtgtgtgtgtgtgcccttctgcaattttagcttgtatgaaatcctatgttatgcttcctgaggccaccccga

SEQ ID NO: 47192 - DNA, 201 bp, Homo sapiens
tgactggggaagatggcagcagacgctttggctactgcaggcgcttactggtgagtgaggccattcggtcctcaggccagcaggcaggggataggccagggtgtgtgtgtgtgtgtgtgtgtgtgtgtgtgtgtgtgtgtgcccttctgcaattttagcttgtatgaaatcctatgttatgcttcctgaggccaccccgaa

SEQ ID NO: 47193 - DNA, 201 bp, Homo sapiens
ggaacattcctcccctggatagacacattgctcacttcctttgggttgtgttcatgtgtcccctggcaagaggggcttccctgacctccctatgtaaaacrgcaactcatctctactgctcatctctgatccctttccccttctttattcttctttattggcccccaaaccgtctcacagagttgatatgttacctgctca

SEQ ID NO: 47194 - DNA, 201 bp, Homo sapiens
gactggggaagatggcagcagacgctttggctactgcaggcgcttactggtgagtgaggccattcggtcctcaggccagcaggcaggggataggccagggtgtgtgtgtgtgtgtgtgtgtgtgtgtgtgtgtgtgtgtgcccttctgcaattttagcttgtatgaaatcctatgttatgcttcctgaggccaccccgaac

SEQ ID NO: 47195 - DNA, 201 bp, Homo sapiens
aacccgggaggcggatgttgcagtgagccgagatcgcgccactgcactccagcctgggtgacagagtgagactgcatttcaaaaaaaaaagagagaaaagaagagcaactctaattttggagccaaaatttgagatccttaggccagtacaggatttttgtcctgatttttgaatttgcttacatgagaagcctttacaga

SEQ ID NO: 47196 - DNA, 201 bp, Homo sapiens
ctggggaagatggcagcagacgctttggctactgcaggcgcttactggtgagtgaggccattcggtcctcaggccagcaggcaggggataggccagggtgtgtgtgtgtgtgtgtgtgtgtgtgtgtgtgtgtgtgtgcccttctgcaattttagcttgtatgaaatcctatgttatgcttcctgaggccaccccgaaccc

SEQ ID NO: 47197 - DNA, 201 bp, Homo sapiens
  misc_feature (1)...(201): n = A,T,C or G, or insertion/deletion polymorphism (see Tables 1-2)
ttgggcgggggatttccctgcttccagggaggtcactccttccttttgtctgtgctctcaatttttccacctggggaagagctgccttgaaaaaaaacccnaaaactccccttagcttaactccttgtctcatagactgtccagtaagtggatcagttcataatcaggaagcaattcatctgtctcctgaaattcccttcc

SEQ ID NO: 47198 - DNA, 201 bp, Homo sapiens
ttttacaaaacacgtttttcttttattttgagacatggccttactctgtcacctaggctggagtgcagtggtacagtcataactcactgcagcctcgaccrcccaggctcaagcaatcctcctgcctcagcctcctgagtagctgggaatacaggtgtgtgccaccatgcctggatagttttttaaatatttagatttttt

SEQ ID NO: 47199 - DNA, 201 bp, Homo sapiens
cctccaggcctctgagtcctgctggagaaggcactgcagcctgcatgggggctccgggcctgggagctctcagtgcatgtctcccctttagctacccaccttttttttttttttttgagacagagtttcattcttgttgcccaggctggaagtacaatggtgtgatctcggctcactgcaacctccacctcccgggttcaa

SEQ ID NO: 47200 - DNA, 201 bp, Homo sapiens
gttcattgcaacactattcacaatagcaaagacatggaatcaacctaaatgcccatcgcagtagactggttaaagaaaatgtacatatacaccatggaatmctatgcagccataaaaaaagaatgaaatcatgtcctttgcaggaacatggatggagctggaggccactatccttagcaaactaatgcaggagcagaaaac

SEQ ID NO: 47201 - DNA, 201 bp, Homo sapiens
  misc_feature (1)...(201): n = A,T,C or G, or insertion/deletion polymorphism (see Tables 1-2)
ctatgtggggtggggctggatactgcacagcacccttcctgcccaatatggaacgggtaggagtcttacttgagagggatgctgtggatggtaaaaacttncatcttggccgggactgatatttaggagagcccctcttgtaaaggaattatcctgtttggttctccaaaaagagatctacaggagaaggcacagacaaag

SEQ ID NO: 47202 - DNA, 201 bp, Homo sapiens
ttttgccttttctttggttttatttgtagttatcccaaatgaaaacaacaacaaaatgtgttctgtattctaagagctgttcaggtacccatctgggtgarcagatgatttaaaactgaattagctttttgaattctgtgcaagtaactctgtgcaagttactatgaagaatgcgcctttgtataagcttgggaatgttta

SEQ ID NO: 47203 - DNA, 201 bp, Homo sapiens
atggcgcacgcctgtagtcccagctgcttgggaggctgaggcaggataattgcttgaactcggaagacggaggttgcagtaagccaagatcgctccactgyactcctacctgggcgacacagcgagactccgtctcaaaaaaaaaaaaaaagatttaccctctaattaggactcttttcaaacaggcttcccctgagtttg

SEQ ID NO: 47204 - DNA, 201 bp, Homo sapiens
ccctagagatgtggctgtgtggttcccttcttctccctatctccaagagcagtcagctctcctctcttcctgaggtcccgatggatggcccctcaactccttccttctggagccttccccgctttcacaggcagccctcttgcccacaggctgggtgttcgagtgctacgagagcagagctgtagtccgagggatggagaa

SEQ ID NO: 47205 - DNA, 201 bp, Homo sapiens
ttcattgcaacactattcacaatagcaaagacatggaatcaacctaaatgcccatcgcagtagactggttaaagaaaatgtacatatacaccatggaatamtatgcagccataaaaaaagaatgaaatcatgtcctttgcaggaacatggatggagctggaggccactatccttagcaaactaatgcaggagcagaaaacc

SEQ ID NO: 47206 - DNA, 201 bp, Homo sapiens
cctctgctgtcagaaaccttttaggattggctcgggagcagaggtccggaagactggttccatcacccaggcccagtaattcttgtcccatagctcaggargacccccgcaaaattcccacttagtcttctttttccactcagatgagagcacaggtgtttttagcctctgctttcgttttttgctggcagtagtgaagct

SEQ ID NO: 47207 - DNA, 201 bp, Homo sapiens
agacctggaaaagagcaggttggaaggggaaagcagcctccagttgcttcgtggagggccagagggcagcacccacttggctggccccggcccactttcccatcgctctcctgcaggtgttagagctgcggcggcccatggactcaaggctggagcacgtggactttgagtgcctttttacctgcctcagtgtgcgccagc

SEQ ID NO: 47208 - DNA, 201 bp, Homo sapiens
ggaggcctagttgggcagatcacaaggtcaggagatcgagaccatcctggctaacacggtgaaaccccacctctactgaaaatacaaaaaattagccgggygtggtggtgggcacctgtagtcccagctactggggagcctgaagcaggagaatcgcttgaacccgggaggcggaggttgcagtgagctgagatcacgcca

SEQ ID NO: 47209 - DNA, 201 bp, Homo sapiens
taattcttgtcccatagctcaggaggacccccgcaaaattcccacttagtcttctttttccactcagatgagagcacaggtgtttttagcctctgctttcrttttttgctggcagtagtgaagcttcctttagggaaggcaagtatctaatctatccctgacctggctgattagcagctaaagtcttaagagagggatgga

SEQ ID NO: 47210 - DNA, 201 bp, Homo sapiens
gacctggaaaagagcaggttggaaggggaaagcagcctccagttgcttcgtggagggccagagggcagcacccacttggctggccccggcccactttcccatcgctctcctgcaggtgttagagctgcggcggcccatggactcaaggctggagcacgtggactttgagtgcctttttacctgcctcagtgtgcgccagct

SEQ ID NO: 47211 - DNA, 201 bp, Homo sapiens
ccctgggatgcaaggattgtgtattagtccattctcatgctgctataaagaactgcccaagactgggtaatttatataagaaagaagtttaattgactcasagttccacatgtctgggaggcctcaggaaacttagaatcatggtggaaggcacctcttcacagggtggcaggagagagaatgagtgtaagcaggggaaat

SEQ ID NO: 47212 - DNA, 201 bp, Homo sapiens
acctggaaaagagcaggttggaaggggaaagcagcctccagttgcttcgtggagggccagagggcagcacccacttggctggccccggcccactttcccatcgctctcctgcaggtgttagagctgcggcggcccatggactcaaggctggagcacgtggactttgagtgcctttttacctgcctcagtgtgcgccagctc

SEQ ID NO: 47213 - DNA, 201 bp, Homo sapiens
tggtgacacagccaaaccatatcagatggctcaacatatgcaaatcaataaatgtgataaaaacagatgggatgtgcctaaacttctaggagttccagagytcctcttcctggttgatgcagattcatttcatagcactgtttggacccagctgtcctgagttaccactccatccagctgccggtgcatctctgatttttt

SEQ ID NO: 47214 - DNA, 201 bp, Homo sapiens
cctacagaatttaatttttccatcttttttttatggagacagggtcttgctgtgttgctcgggctgctcttgaactcctgggctcaaacagtcctcttgcstcagcctcccaacgtgctgggattacgggagcaagccaccccactgtgtgcagcccagaagttgagcctgagaggtaggcttattgccctgtgtctaccc

SEQ ID NO: 47215 - DNA, 201 bp, Homo sapiens
cctgaccttagtggcccctaagagagcctggaccatgaggtttcttttcctgaaggttctaccctctaattcagggctgagcttcctctttgccaccctgcccccccccaggccagctcccgtggggctgtgaatacagctattgtttcctgtggttgcagctgcctctgagcacattccaggaccattctgggagggacg

SEQ ID NO: 47216 - DNA, 201 bp, Homo sapiens
tgatttaatttaagaaaataaatgtatgttgaatggtagaaaatagttcacaagtttgagaccagcctgggcaacatggcaaaaccccctgtctacaaaawataaaaaaattagcagggtgtggtggtgcacacttgtagtcccagctactcgggaagctgaggtgggagaattgcttgagcctgggaggcagaggttgca

SEQ ID NO: 47217 - DNA, 201 bp, Homo sapiens
atggccttgtaagaagggagtgttctgctggcactagctgtgcgggggacagtagtccttgaccctttgttcttttcactctgccttcctcctctcagtcrttcacagctcagccaaccagctaagtggggtgtaggcagatgtatcaccccagggtaaggagccccagacagggagggaataaaagctttctgaattctt

SEQ ID NO: 47218 - DNA, 201 bp, Homo sapiens
atttactatttaataaatgtcatctgtgctttgtttagcataggttatttttattttaacacagactgttttctatgggtaatatatgtgatatatatatwttttaacagaaagggatgatttattaattttacccccaagtaatataaagtgaacatttccctattttactaaatattcttcaacagcagtgattctcat

SEQ ID NO: 47219 - DNA, 201 bp, Homo sapiens
  misc_feature (1)...(201): n = A,T,C or G, or insertion/deletion polymorphism (see Tables 1-2)
ttcctcctctcagtcgttcacagctcagccaaccagctaagtggggtgtaggcagatgtatcaccccagggtaaggagccccagacagggagggaataaangctttctgaattctttctttcctgcaaattcaaaaggctaagtggtgctcaagtatgttccctgacatccctgggagtaatgctcaggaattcccccaaa

SEQ ID NO: 47220 - DNA, 201 bp, Homo sapiens
gtagtgaagcttcctttagggaaggcaagtatctaatctatccctgacctggctgattagcagctaaagtcttaagagagggatggaagttccagggcaasatggcggggatccagggatgccggcccttggcctctgtgtccccatcccagcagacagacactggccaaggcctctgtggcaagcccctctcgcacgtcc

SEQ ID NO: 47221 - DNA, 201 bp, Homo sapiens
agtgttcaaaattctttttagtaagagaaccctttttttctgaactttttacaaccatctccaaattataaaacataagacttttttttttagtaaaaatrtatttttttacaagcacagtggcttgcaccatggaggggagaggaggtgttttgtccttggagctgctggcctgagagaaccttgtcatcgtgggagctg

SEQ ID NO: 47222 - DNA, 201 bp, Homo sapiens
  misc_feature (1)...(201): n = A,T,C or G, or insertion/deletion polymorphism (see Tables 1-2)
gtgccagagctggttcagctgtttggggcccttgggcattaggaacgggagaggcatcaatttacctgtggagggtagagccctgccaggaaatggccacntaggagggaggagcagacagggaagaaaggtctgggatgggttccttcagactttgggctgtgaggccctgagcagggaggtgggtgtgggaatcggctt

SEQ ID NO: 47223 - DNA, 201 bp, Homo sapiens
tttgctggtgtggtcacctcagaagtgagggaaagcctgttgccctgagcatgggtagaaagctggcttcagacccctttgctcttctgtggaactccccrcccacctttcttgttcagttgaacagtgtcaatatcagagcctctaatacaattaagggatcctatttgaagccctttcttaaaggttattggaaagtgt

SEQ ID NO: 47224 - DNA, 201 bp, Homo sapiens
agttgacagtggttactctagtagacaagtagaaaagtgtgcccaagaggaagtatgctcatggtgctcttcaataagctcacctttcccttccttttgctcttcatcattcaccgagcaccttccagacactatttgtttgtccctgggcctagaagaaaccatggtctagtagggaagaccaagaagtcccttgatact

SEQ ID NO: 47225 - DNA, 201 bp, Homo sapiens
tgctggtttcccctgggcgcactcatgtagctgtgtccggctgggtctgggtccaaggtggcctcattcatgagtcaggcagttgtaggctggctattgayagaggtgcctcggtcacattccatgggacctctcgtcctctaaaagactagactggcttccttatgtgacggtgtcagggcagcattccaggtgggtaaa

SEQ ID NO: 47226 - DNA, 201 bp, Homo sapiens
  misc_feature (1)...(201): n = A,T,C or G, or insertion/deletion polymorphism (see Tables 1-2)
agtgtgcccaagaggaagtatgctcatggtgctcttcaataagctcacctttcccttccttttgctcttcatcattcaccgagcaccttccagacactatntgtttgtccctgggcctagaagaaaccatggtctagtagggaagaccaagaagtcccttgatacttacaagtgctgtggcaggggtgtgctgagtgctgt

SEQ ID NO: 47227 - DNA, 201 bp, Homo sapiens
  misc_feature (1)...(201): n = A,T,C or G, or insertion/deletion polymorphism (see Tables 1-2)
tagaagaaaccatggtctagtagggaagaccaagaagtcccttgatacttacaagtgctgtggcaggggtgtgctgagtgctgtggggatttctcttgagntgcctcagggccctggcagttcagaaagtggcagaggcactgcttcctcttcagagagtcagcccagtgtagtggaagttcacgtcctggtttcacttac

SEQ ID NO: 47228 - DNA, 201 bp, Homo sapiens
ggaagattaaatgagttaacatatgtaaaaacatttattcagaagtgttccttgtagttgccaagatctgcatatggatttggagctgggacatggtagaygccaattattggatgtgatgccactgctggagggtggagctgcctaaggagttggcctccccaccccattggcttcctcaatgatagagtggaaaagact

SEQ ID NO: 47229 - DNA, 201 bp, Homo sapiens
ctcaatgatagagtggaaaagactctttcctgaggggcgcttctgacctgtctgaggccctcagggattctaattctggtcagaacccaacatgaagaagygagatgttatgtctagtagcagaagtcccaggggagacagaggcttgttaaagggaaagatcaaagggtctgagtgtatttgggggccacttcagggagt

SEQ ID NO: 47230 - DNA, 201 bp, Homo sapiens
gccggatccagaaaattgaacaggtcctgaaggagcagccgggccgggggctcccccagctccccagcagctgctacagcgtggaccgggggaaaaggaasactggaaccttgggctccttggaggagccggcagggggcgcgagtgtgagcgctggcagccgggcagtcggagtggctggtgttgcgggggaggcgggcc

SEQ ID NO: 47231 - DNA, 201 bp, Homo sapiens
gaaatagccctagctcccagcggctgccatcgaagagttccctcgatcccgctgtgaaccctgtccccaaacccaagcgcacctttgaatacgaggctgasaagaaccccaagagtaagcccagtaatggtctacctccttcacccacacctgctgctccacctcccttgccctccaccccagccccgccagtcacccgga

SEQ ID NO: 47232 - DNA, 201 bp, Homo sapiens
tctgcagggtccctgaaccccattagcatttttgttgcactgggaggtttacgatcaaaggctgtcctgagcctccagcgagctctaagttcctgggcctrggctcaggtactctgtctctctgtctgcccatcagtaccctctccagctgctcccacgcggtggtggccttgctctaccccttctcctggcagcacacct

SEQ ID NO: 47233 - DNA, 201 bp, Homo sapiens
tttaaaagggccctaattggtgaaggccctgcactcatgacctaatcacctcccagaggcctcacctgtgtttccacataggaattttgggggacagaaayattcagtctattgtacaagctaacacatttcattgccccagtttcatggtgctggcagaagacacgagacccctgggtcgcaaaggactttattacttat

SEQ ID NO: 47234 - DNA, 201 bp, Homo sapiens
ccagagcatggatgaagtttcgctgggtgctcgtgactggccagttttgtgcagctgactgtctcagccaaaccactgatcttccctggaggccttcggcbtgcctgcctgcctgaggtccccgctgccagtcccgggccctggagagcagatgctgtcttgttatgtacaggaggaccttttaaaaaaatcaagtttcta

SEQ ID NO: 47235 - DNA, 201 bp, Homo sapiens
  misc_feature (1)...(201): n = A,T,C or G, or insertion/deletion polymorphism (see Tables 1-2)
ccagttctactcagccacccaagaggcagccaatgctgttcctgtatttctcacctccttatgcaagactaacatcccagagtggaagaaagtcctcccgnatgagtgagtaggcagaggcctagaaacacttgccctcctctttcccttctctcaaacctgacctaagaaggcctggggaacagctgtgttgcccagaac

SEQ ID NO: 47236 - DNA, 201 bp, Homo sapiens
  misc_feature (1)...(201): n = A,T,C or G, or insertion/deletion polymorphism (see Tables 1-2)
gtttctgtccttcaagatcttaaattgctttctactctccccgctccctccacattcctctgcttttcctttcatcatctccctcatcttcccttccttgnatcgtggggtctaattgatttctctatcacacaggttgttcaatgttgatctctaagtgaatgaacattcataaggacctctttttacacaaaggcaaac

SEQ ID NO: 47237 - DNA, 201 bp, Homo sapiens
ttaccttattgaagaatttctccaaagaccccttctcttatttttttggctctgatgtcatgaatgtactgttgttggggagggtgttgaaactatcactrtactcttctcatctaaaactgcctgaatgttagatttcactgtccttataaaagagtgaattatatgcagttagcgtatgaagccttcttaaccaaagca

SEQ ID NO: 47238 - DNA, 201 bp, Homo sapiens
cctgggtgtgtaataatacaagatttcctaataacacaggatttcctccccacctctcaaagctgcttgtgttcagttcctgccacttgacagacagctccccatgtcttatggctgctgcatcaggcagaatgatcaaagaaagggcacagggagccatggacaaggtagggagagaaagacaattgctttggaaagtca

SEQ ID NO: 47239 - DNA, 201 bp, Homo sapiens
ctgggtgtgtaataatacaagatttcctaataacacaggatttcctccccacctctcaaagctgcttgtgttcagttcctgccacttgacagacagctccccatgtcttatggctgctgcatcaggcagaatgatcaaagaaagggcacagggagccatggacaaggtagggagagaaagacaattgctttggaaagtcac

SEQ ID NO: 47240 - DNA, 201 bp, Homo sapiens
taacactttcctaccttaacttctggtatatatttaccttttaaactcaagtcaatcagaatcttgttttgagaatgttgtgatatgctggaaattaatgraaaaaacccactagattctgcataggatgttgcattaaagattctatcaggctgggtgtggtagtacacacctataatcccagctactcaggagtctgag

SEQ ID NO: 47241 - DNA, 201 bp, Homo sapiens
cctggagttcagggttatagtgagctatgattgtgccactgcactctagcctgggtgacagagcaagatcctgtctctaaaataataataataataataayaataataataataataaatacatggtgaagactgaggactgtagacactacacgtggaactttgtactcatttgcaaagaccttaggacaaaaaggtctg

SEQ ID NO: 47242 - DNA, 201 bp, Homo sapiens
caggcacccaccatcatgcccagctaatttttgtatttttgtagagacggggtttcaccatgtttgccaggctggtcttgaactcctgacctcaggtgatycacgcgccttggcctcccaaagtgctgggattacaggcatgagccaccatgcccagcaggaattacattttgttgataagaaaacctaagataacctttt

SEQ ID NO: 47243 - DNA, 201 bp, Homo sapiens
caaagattgtcttttcccttccagaatgtaataccctcaatgggctggtgtcggaggtgtttatccggttctttgtggagaccgttgggcactactccctytttctgacacagagtgagaagggagagagggcctttcagcgagaggccttccgcaaatctgtggcctccaaaagcatccgccgctttcttgaggttttta

SEQ ID NO: 47244 - DNA, 201 bp, Homo sapiens
tattaaattttttctttactaaaaatttgtgaacttcttttcacttaaggatgtaccataacaattaaaaacattttctgtgacattaaagaaatattcctttttttttttgagatagggtcttgctctgtagcccaggctggagtgcagtggcatgatctcagctcatgcaacctcctcctcccaggttcaaatgattct

SEQ ID NO: 47245 - DNA, 201 bp, Homo sapiens
ctgcagcctcgacctcttgggctcaagtgatcctcctacctcagactcccaaatagcagggaccacaggcatgcacctccctgtccatgcctggctaatgtttttttttttttttttcggtagagatggggtctccctgtgttgtccaggctattggttaccttctttatcatagttcaatcctgagggtgtttccttggc

SEQ ID NO: 47246 - DNA, 201 bp, Homo sapiens
ttctgatttttaatcacttgtcagttatgtgctctgtaattattttcttcctgtctgtggcttatcttttaactttgtataggttatccttgtgaggttatgtgtgtgtgtgtgtgtgtgtgtgtgtattcctaaattgttttccagaaaaattatactggtttacagaacatccaacagtatatgagagtgcccagcttg

SEQ ID NO: 47247 - DNA, 201 bp, Homo sapiens
tctgatttttaatcacttgtcagttatgtgctctgtaattattttcttcctgtctgtggcttatcttttaactttgtataggttatccttgtgaggttatgtgtgtgtgtgtgtgtgtgtgtgtgtattcctaaattgttttccagaaaaattatactggtttacagaacatccaacagtatatgagagtgcccagcttgc

SEQ ID NO: 47248 - DNA, 201 bp, Homo sapiens
ttgaacccgggaggtaagaggttgtggtgagccgagattccaccattgtactgcagcctgggcaacaagaatgaaacttcgtctcaaaaaaaaaaaaaaagaaagaaagaaagaaagaaaagaaagaaaaaggaaaccccgagcatgcttttggcagaggtaggtgcagagaggctggagagcatggtaacccagagggga

SEQ ID NO: 47249 - DNA, 201 bp, Homo sapiens
tgggctgcacccactgtactgcacccactgtctgacaagccccattgagatgaacccggtacctcagttggaaatgcagaaatcacccgtcttctgtgtcsctcatgctgggagctgtagactggagctgttcctattcggccatcttggaaccacctgtccatcctttttaaggctgaataatattctgttgtatgcaca

SEQ ID NO: 47250 - DNA, 201 bp, Homo sapiens
cttaaaaatgcacccaaggaagcagcttgttaaggaattatgtggagtggcctcggcgcctgagctgcattcctgcagattcccactcccatcagctagcmtgggctgagggagcgtttccaggaacttcagtgggatgcaagccggggaccgggccagtcagcctggactgcaaagtcttttgagcctccactctctctg

SEQ ID NO: 47251 - DNA, 201 bp, Homo sapiens
tttttggctgttatagctaaggagatgctaatgtctcctggtggatagaagccaaggttgccactaaacatcctaaaaatggacaggacagtctaccacarcaagaattattcaaccccaaatgtcagtggcttggagaaacccctgggattgggacaaggcttcctataggttggggatgacaataaaggccctggctga

SEQ ID NO: 47252 - DNA, 201 bp, Homo sapiens
caccctgtgggaaacaggaagacagggccctagtgggagtcttggcattctgcaactctgccagaagtcatctcagtactggcattagggggctaggtgtrggtccccaaaccacatttggagagccagacaggtgtctgtgacacctggagccagtcctgtgggagagagtaagcatgaatctttaaggaatggatgggg

SEQ ID NO: 47253 - DNA, 201 bp, Homo sapiens
ccccaggtaactctaattctctttgcaaatggaaggacctggatattatatagcattggccagataatataaaatgataatataaaaatgatttcttctgsctttggaataaggtgtttgtttttataaaagatttaccccatagctgggagtggtggctcacgcatgtaatcctagcactttgggaggccaaggtgggca

SEQ ID NO: 47254 - DNA, 201 bp, Homo sapiens
attgaagaattttcagcaatgattttcacacataggcagccaggcccaaatccccagcccaacgcagcaggatttagccagatggtatttttaacctgcaracaatgcttgggtatattgggaatttagcttcttcctgtcggggccccaggttatggcccagaggggaaaggctagaatccttgttcctgttattgcatc

SEQ ID NO: 47255 - DNA, 201 bp, Homo sapiens
taggagggaggagcagacagggaagaaaggtctgggatgggttccttcagactttgggctgtgaggccctgagcagggaggtgggtgtgggaatcggcttytgcaaaaggaaaggccagactcactgagcattgcggtctgtttcccatttcaaatcttgacctcctggaggcagggtccatcttttccaggcctgtaggc

SEQ ID NO: 47256 - DNA, 201 bp, Homo sapiens
ggagcctggccccaggccactcagctccctgcctgcagatgcctgaccatgggcccagagtagcccagagaaggtagagatccatcccctgtgagaaaagytggggtggtgggggagcaaaaaacattggctgtgaggtccagcaagtatgtactctgctgttccttttccagatgaaaacagtgagagcgagagcgactc

SEQ ID NO: 47257 - DNA, 201 bp, Homo sapiens
aggagttcgagaccaccctggccaacatggtgaaaccccgtctctattgaaaatacaaaaattagccaggtgtgttggtgggcccctgtaatcccggctaytcaggaggctgaggtgggagaatctcatgaacctgggaggtggaagttgcagtgagccaagatcacgccattgcactgcagcctaggcaacagagagaga

SEQ ID NO: 47258 - DNA, 201 bp, Homo sapiens
tagtcccagctactcgggaagctgaggtgggagaattgcttgagcctgggaggcagaggttgcagtgagccaagatcttgccactccactccagcctgggygatagagccagaccttgtttcaaaaacaaaacaaaacaaaacaaatctacaatagcagcagtgtagaatatgtagaatttagtaaaaaggaaaaaaattg

SEQ ID NO: 47259 - DNA, 201 bp, Homo sapiens
cttactattaaccctactattagtattatattactattagtttattaaggatacaactcaggaacagccaaatggaagagatgcatagggcaaaattttggtgtgtgtgtgtgtgtgtgtgtgtgtgtgtgtagagcttccattccctctcagggtgcaccaccctcccggcaccttgatgtgttcaccaacccgggagct

SEQ ID NO: 47260 - DNA, 201 bp, Homo sapiens
ttactattaaccctactattagtattatattactattagtttattaaggatacaactcaggaacagccaaatggaagagatgcatagggcaaaattttggtgtgtgtgtgtgtgtgtgtgtgtgtgtgtgtagagcttccattccctctcagggtgcaccaccctcccggcaccttgatgtgttcaccaacccgggagctc

SEQ ID NO: 47261 - DNA, 201 bp, Homo sapiens
tactattaaccctactattagtattatattactattagtttattaaggatacaactcaggaacagccaaatggaagagatgcatagggcaaaattttggtktgtgtgtgtgtgtgtgtgtgtgtgtgtgtagagcttccattccctctcagggtgcaccaccctcccggcaccttgatgtgttcaccaacccgggagctct

SEQ ID NO: 47262 - DNA, 201 bp, Homo sapiens
atgaacaacacagtccttgtcctctggaacgtattctgtaattgagaaataaggaattaaaaagaattgatagtctccaaatggaatttaagaattaaaacttcttcttcattttggcctctcagggtctctcattttctgaggtctccttgggggaccctagaaaacacatctaatccctttttcacacgagagcctttc

SEQ ID NO: 47263 - DNA, 201 bp, Homo sapiens
tgaacaacacagtccttgtcctctggaacgtattctgtaattgagaaataaggaattaaaaagaattgatagtctccaaatggaatttaagaattaaaacttcttcttcattttggcctctcagggtctctcattttctgaggtctccttgggggaccctagaaaacacatctaatccctttttcacacgagagcctttcc

SEQ ID NO: 47264 - DNA, 201 bp, Homo sapiens
  misc_feature (1)...(201): n = A,T,C or G, or insertion/deletion polymorphism (see Tables 1-2)
cctttctgcatattgttgtcacataaactaatcatctcttaattactttgtccttccagaatgaattaaaaaagattctataattttagccagcactaganctataggcagccgtgggtggggaagcaggataagaaactgtgatgagactgatatgcatggcatgggacaggtggcaagagaataatttagtttgtgatc

SEQ ID NO: 47265 - DNA, 201 bp, Homo sapiens
gaacaacacagtccttgtcctctggaacgtattctgtaattgagaaataaggaattaaaaagaattgatagtctccaaatggaatttaagaattaaaacttcttcttcattttggcctctcagggtctctcattttctgaggtctccttgggggaccctagaaaacacatctaatccctttttcacacgagagcctttccg

SEQ ID NO: 47266 - DNA, 201 bp, Homo sapiens
tatggtaatgaatgtgttaatttgtttgtgatagttgtttcacagtgtattagtatatctaattatcatgctgtacatctttagtatatagaacttttgtyaatcataactcagtaaagttggaaaaaattgagaaattatttaaaatatgtagaatgtctatttttatatgtatagtttaagtgacccaccacctagctt

SEQ ID NO: 47267 - DNA, 201 bp, Homo sapiens
gagacttaaaaacacctgctgcagagactcccaaactttcttagttcatgggccttagtgtttcagtaatttttttttttacagtgtccatagcccaaaakaaatacctaagttttcttttataagtaggttttttgtttgtttttatatgaagtctcactctgtcacccaggctggagtgcagttgtgtcactgtatcct

SEQ ID NO: 47268 - DNA, 201 bp, Homo sapiens
cacagtgtattagtatatctaattatcatgctgtacatctttagtatatagaacttttgttaatcataactcagtaaagttggaaaaaattgagaaattatttaaaatatgtagaatgtctatttttatatgtatagtttaagtgacccaccacctagcttaagaaagaaaatgctactattaactttaaaatctcctgtg

SEQ ID NO: 47269 - DNA, 201 bp, Homo sapiens
ttttcctccaaagggaaattgagccctaatgatctaagatctgtagttccagtgttaccctctaccctctactgcttcttttttcttttcttttcttttgttttttttttgagattgattctcgctctattgcccaggctggagtgcagtggcgcgatcttggctcactgcaacctccgcctcccgggttcaagtgattct

SEQ ID NO: 47270 - DNA, 201 bp, Homo sapiens
atatgtatagtttaagtgacccaccacctagcttaagaaagaaaatgctactattaactttaaaatctcctgtgtccttaccagtaattgatttaatttargaaaataaatgtatgttgaatggtagaaaatagttcacaagtttgagaccagcctgggcaacatggcaaaaccccctgtctacaaaaaataaaaaaatta

SEQ ID NO: 47271 - DNA, 201 bp, Homo sapiens
taggctgctgcttagttagcaatagagtagatgcatgaaaactaccaccaccattctattggtacctaaatgttcaaagtaataactctgactgtacaaawgttaatgtgactaaccttttcataacttactatttcaatcgaaactccctaagcatttatcgttccattattttattagaatgcttatttgaattcacta

SEQ ID NO: 47272 - DNA, 201 bp, Homo sapiens
acaagtttgagaccagcctgggcaacatggcaaaaccccctgtctacaaaaaataaaaaaattagcagggtgtggtggtgcacacttgtagtcccagctaytcgggaagctgaggtgggagaattgcttgagcctgggaggcagaggttgcagtgagccaagatcttgccactccactccagcctgggcgatagagccaga

SEQ ID NO: 47273 - DNA, 201 bp, Homo sapiens
agtgatccgcccaccttggcctccaaagtgctgggattacaggcctgagccaccgcgcccggcctcaggatgtatcttaaactcattatttttgatgcttkccctgcagctgagtaaatacctctttaggatatgtgacaattgaactggcttggattttggaacatgtcctggccttggagcctgcttatgttcatacac

SEQ ID NO: 47274 - DNA, 201 bp, Homo sapiens
cagtgacgtgatcactgttcactgcagcctctatctcctaggctaatgtgatcctcctacttcaacctcctgtgtagcggggactacaggcttgtgctaatttttttttttttatttttggtagagacaaggtctctatgttgcccaggctggtcttgaactcctggtctcaagagatcctcccaccttggccttccaaag

SEQ ID NO: 47275 - DNA, 201 bp, Homo sapiens
tgggattaacaggcatgaaccaccgcgcccggccaccctgcttattttttttttaagccccgctctgagatgttgtggttgaccatctcactctgctgacragaatgtgtaaggtcggggaccttgtcccctttgttttccattgagagccaagagccctggcgcatagcaccgtgtcagatgccatatagaaagcactcc

SEQ ID NO: 47276 - DNA, 201 bp, Homo sapiens
aatgttttggaaactcctttgagtaggcaggggtcactttgggtggcttttttctttctttgatgtgaagttgggatcttggatgtaaatttagccaaggrcaagtttgaatttagattttttaaattttttccgtcttgttccattcttccttttggaggcggctaactagagtggggtaaaaagtgcctttaatcagag

SEQ ID NO: 47277 - DNA, 201 bp, Homo sapiens
attgccagcacatgaatccaaggaggagactcctcggtgtgaccagagctttagttggggaggggagggtgttggggccttggaaagctgggcctttgacyctttggctacgtcggggacttccacatcatccacatgaaggcagaggaacccagtggttctaagacgcatttgtatccagctttgggggaagagggaggt

SEQ ID NO: 47278 - DNA, 201 bp, Homo sapiens
gctgaatcttaccaggcatacgctgaaatggaatgtgtatgtggatcaatgccactgctggtttgtcctttatgttcccccatgtttcgcaatgctttggttttttctttcatgactaccctgagaggtagatcaatgttgtaatttgtttaaaagcttttcctcgccctaaacatcttaggtaagttgatgtgccttttc

SEQ ID NO: 47279 - DNA, 201 bp, Homo sapiens
taataaaatccagaacaattgaataccatacagttcacccacttaatgtatacagttcagtgtttgggtgtattcacagaattgtgcaatcatcaccacaytcaattttagaacatttttatcaccccaaagagaaactctgcacccactagctgtcactccgcacttctcccaccagcctgtctctcactccgccttccc

SEQ ID NO: 47280 - DNA, 201 bp, Homo sapiens
gcactcaggaccacagtgtttgcataggaagtggcgtaagaggcaggccgggcgcagtggctgacgcctgtaatcccagcactttaggaggccgaggcgarcggatctcaaggtcaggagatagagaccatcctggctaatatggtgaaaccccttctctactaaaaatacaaaaaaattagccaggcgtggcagcgtgtg

SEQ ID NO: 47281 - DNA, 201 bp, Homo sapiens
tcccgtcatctagagaggctgctgctcagaataaaagagaggaacataagatgggcgcccaagaggagtgctttattgagcctttagattgccagcctgarcgagatagtcttcccctccttgcttggcatctggagccagcttgtacactacacgtttgaggtttgctgttctcttcttttcttttctctcttctctact

SEQ ID NO: 47282 - DNA, 201 bp, Homo sapiens
cttcttttgagacagagtctccctctgttgcccaggctggaatgcagtggtgtgaacacagctcactgtagccttgaccttctgggctcaagtgatctttmcacctcagcctcttgaatagctaggaccactatgtgggccactatgcctggctaattttttcaaaaaaatttttttgtagagaagccgaggcaggcggat

SEQ ID NO: 47283 - DNA, 201 bp, Homo sapiens
tagttcttacagggaaactccagtgccttttgagccgcttgttcgtcctagtgaacactgtctgttttgtctcttggtgctgctatgtctgacctgtaatggaaaaaaaaaaaaaaaaaaggctaattaagctcagccaggagcctgtggtgagttccaagtccctctagagcatttattaggacagagggactgtcacag

SEQ ID NO: 47284 - DNA, 201 bp, Homo sapiens
gttcttacagggaaactccagtgccttttgagccgcttgttcgtcctagtgaacactgtctgttttgtctcttggtgctgctatgtctgacctgtaatggaaaaaaaaaaaaaaaaaaggctaattaagctcagccaggagcctgtggtgagttccaagtccctctagagcatttattaggacagagggactgtcacaggg

SEQ ID NO: 47285 - DNA, 201 bp, Homo sapiens
gtatgccgaggaggtagagataactaagacattgaagtccttgttgtcatggagcttgacgtgtagtgagtggggaagcatttcagtaaacaagtaaacawatcaatagatgagatcaagatagtgctgtgagctcggaaggatataatggtgatgtaaaagagagagtaacagggacctgagaggttagagaaggcctct

SEQ ID NO: 47286 - DNA, 201 bp, Homo sapiens
  misc_feature (1)...(201): n = A,T,C or G, or insertion/deletion polymorphism (see Tables 1-2)
ggtctcactctgccacccatattgtgcagtggtgctggagtgcagtggtgctatcatggctcactgcagcctcaccctcccgggctcaagcgatcctcccncttcagcctcctgagtagctgggactacaggcgtgcaccaccaaacccagctgacttttgtattttctatagagacagggtttcaccctgttgcccaggc

SEQ ID NO: 47287 - DNA, 201 bp, Homo sapiens
aggctgtaactactcagctccttcagccccctgggcttgatctccttgaaggcagggatgcagggaacaaggccgggagtgggagcagcctgtgtgaattstcaatccctgggggaagggggagggttgggccccagggacagtagggactggagctgggtgctagagagcagagcctgttgggctgcatgcagggagctt

SEQ ID NO: 47288 - DNA, 201 bp, Homo sapiens
atgctgagccagccagcgagggtcctgtggagggtgtcccctggagaaggcaactgcagtggcccagggctgggcaatgggagggctggggagaaggatgygatgggggcactgaggtgcagagaggagagtgggtgaggaaggctggccagcccacaccgggaaacagatgatgtgcagggcctggaggtgccagggaag

SEQ ID NO: 47289 - DNA, 201 bp, Homo sapiens
gccagcgagggtcctgtggagggtgtcccctggagaaggcaactgcagtggcccagggctgggcaatgggagggctggggagaaggatgtgatgggggcaytgaggtgcagagaggagagtgggtgaggaaggctggccagcccacaccgggaaacagatgatgtgcagggcctggaggtgccagggaagtcggggagctg

SEQ ID NO: 47290 - DNA, 201 bp, Homo sapiens
  misc_feature (1)...(201): n = A,T,C or G, or insertion/deletion polymorphism (see Tables 1-2)
ggcagcatgagcaaaggcccagaggcagaaaagatgttggcttgtatgggctggaaataggtggtctattggaatcagcaggtttataaaggagcccatcngagacagaccaggctgaatcagatcctctgggatcttgaatgtcatcttgaagactttgagtttggaatgagtgggaggcatgtgaaaatgctttgacta

SEQ ID NO: 47291 - DNA, 201 bp, Homo sapiens
ttatgtaacgtacaggtttgcaatcattgttgtcaactacaaaaagcctttgttagtcgtggaaatcctcctggctctctacaaaggagcacaacccagtrctctcccctatggaaatgtacttattgtctgttacacaccaatgacggagctgaggactccctgggtaccaggcatagtgatgtggacacagaaacagag

SEQ ID NO: 47292 - DNA, 201 bp, Homo sapiens
aaagcctttgttagtcgtggaaatcctcctggctctctacaaaggagcacaacccagtgctctcccctatggaaatgtacttattgtctgttacacaccartgacggagctgaggactccctgggtaccaggcatagtgatgtggacacagaaacagagtatagagacgaaacaacagtctaacttcattcctgagacaca

SEQ ID NO: 47293 - DNA, 201 bp, Homo sapiens
ctcaaagagaaagataggagaaagcccttctatccagagaaaaggagcagactgagcaatttcgggggttctgagaacccagtggttgggaattcccttasagagcattgggccagctgtcgtaggttggtggcagtcttcatttaaggcagatggttatcttgttttttgctatttcatcagctcattcgagggcttttt

SEQ ID NO: 47294 - DNA, 201 bp, Homo sapiens
cttagaagaactcccagacactgagcagagtggaatgaataagtttctccgaggtttgggtaagtggccttgttactgatgagatagatgttcagcaagawggaaggggctgggagatttgtgttcccgaatactctaaatcaatgtcaacaggtgttatactggggctgtagacagaacaggatgtagacatcccatagt

SEQ ID NO: 47295 - DNA, 201 bp, Homo sapiens
tacccaggcctttttgagcagcgagtggagcagtacttagaagaactcccagacactgagcagagtggaatgaataagtttctccgaggtttgggtaagtrgccttgttactgatgagatagatgttcagcaagaaggaaggggctgggagatttgtgttcccgaatactctaaatcaatgtcaacaggtgttatactggg

SEQ ID NO: 47296 - DNA, 201 bp, Homo sapiens
  misc_feature (1)...(201): n = A,T,C or G, or insertion/deletion polymorphism (see Tables 1-2)
gtcaacactgtgcaggtcctgccagatgtggcttccaggtggagggggcccaggattgccatcttgaggaagacatttgttttgttgatctgaaggccctnatagcacccaggtagagaatgcttgatttgcaatagacagattgtcttccaagagaacttaggtattgtcagctgttcaatgtctgctttgtaaaggcaa

SEQ ID NO: 47297 - DNA, 201 bp, Homo sapiens
  misc_feature (1)...(201): n = A,T,C or G, or insertion/deletion polymorphism (see Tables 1-2)
tccaggtggagggggcccaggattgccatcttgaggaagacatttgttttgttgatctgaaggccctaatagcacccaggtagagaatgcttgatttgcantagacagattgtcttccaagagaacttaggtattgtcagctgttcaatgtctgctttgtaaaggcaactttgtctcagacttatggataggggtgagtct

SEQ ID NO: 47298 - DNA, 201 bp, Homo sapiens
  misc_feature (1)...(201): n = A,T,C or G, or insertion/deletion polymorphism (see Tables 1-2)
gtcagctgttcaatgtctgctttgtaaaggcaactttgtctcagacttatggataggggtgagtctgagcaaggacctcagcaggagccttagtcctcttncaggccatttcctaatttccccattctgtaatttagcacctttcttctctgtccagccctccttaggcaggaagcctgagtcttccattttttttcttct

SEQ ID NO: 47299 - DNA, 201 bp, Homo sapiens
taggactgggtgactgcgtagaatgatgcagtaggacagtcaagccgaaggatgcttgaacagctagtccagccctctcatgtggaggaaaaagcaaaggccctaagggagacagggacttgcctaggattttaccattccagaaagctggaagccaggactgggctccagcctgctagctgtctactcttgaattttaaa

SEQ ID NO: 47300 - DNA, 201 bp, Homo sapiens
ggggatcatttggtatgtcttcccgggagaatgctcttgaacctagttttgagagttggggcctcaagaagagactttggcaatgcccttatttaaatgtyagaaatgtttggttgcatttttgatgcattgcttacatagttaatgtttttgtatttggtacttgtcattttaataatttattaaacaggtgatttaggt

SEQ ID NO: 47301 - DNA, 201 bp, Homo sapiens
atatgtgttgtatgaacaacagggatagggacatggcagacccagtgtcaaagagcagaatgggaattgggaaggctgatgggagggtgagggagatagarggctctagatagtgaagtggcaaatgtctctgggcatttgtggctaaggcagtaagaggcatcaaggtaagttcctggtacttcatcttcccaagagata

SEQ ID NO: 47302 - DNA, 201 bp, Homo sapiens
  misc_feature (1)...(201): n = A,T,C or G, or insertion/deletion polymorphism (see Tables 1-2)
cttggttcactgggtaaagagctagttggagtgaccacggggctgctctggatcagaaaagagctgaatcttaccaggcatacgctgaaatggaatgtgtntgtggatcaatgccactgctggtttgtcctttatgttcccccatgtttcgcaatgctttggttttttctttcatgactaccctgagaggtagatcaatgt

SEQ ID NO: 47303 - DNA, 201 bp, Homo sapiens
  misc_feature (1)...(201): n = A,T,C or G, or insertion/deletion polymorphism (see Tables 1-2)
gtaccctgcagcgagtagcttggttcactgggtaaagagctagttggagtgaccacggggctgctctggatcagaaaagagctgaatcttaccaggcatangctgaaatggaatgtgtatgtggatcaatgccactgctggtttgtcctttatgttcccccatgtttcgcaatgctttggttttttctttcatgactaccc

SEQ ID NO: 47304 - DNA, 201 bp, Homo sapiens
catcttgaagactttgagtttggaatgagtgggaggcatgtgaaaatgctttgactattgttctgtctttctctacagggatggtgacagaatggatagtytagaaaatggattggaattgaggaggaaactagaagctaagaggagttaggaggcccttgtaacaatccaggtattattgctaagggcctagtatcattt

SEQ ID NO: 47305 - DNA, 201 bp, Homo sapiens
  misc_feature (1)...(201): n = A,T,C or G, or insertion/deletion polymorphism (see Tables 1-2)
aaaaggagctatgggtaaagcagtgattttagaagattaaggtgacatctatgtacaggaatgtgacatgctcatcacaagtcatgtgcaagtcataattnctaatgaggaggttcaaaaaggaaatgtagccaggatatctgggtgtttcaattcctgtctcacttactgtaccctgcagcgagtagcttggttcactgg

SEQ ID NO: 47306 - DNA, 201 bp, Homo sapiens
gtctcagagaggaggaaatcatgactcagagaaattatgtaaatcactgaagatccaggatttgaactttggttcatttgattgcagatttctttctactrctttgtgatgccgccttgtgctgaaatcgtggagaatgggggatactctggattgaactggggaactcatggtatccagctaactggcctgaaaacccaa

SEQ ID NO: 47307 - DNA, 201 bp, Homo sapiens
ttttaaagatgagggaattcttgtttttaaaaagacaagatcaaaaagatacgtaactggcttgggatgacacaagtggtaaagtggcagagctggaattycaatgcctggctctcagactaacatgggtgctttcacagctgccttctccaaagagcagtgggaggtccagtggaagccgaactgtggtcaggttgaatt

SEQ ID NO: 47308 - DNA, 201 bp, Homo sapiens
ctcctccgtattccaggccaggggtttcttggggtctcttaagctgtaacacatggagttaaacattaagtgggaaagcagtttctactacctgccacagrcaccctcttggcacttttggaggtcatctggaagatgttcaaggtgcttttggctgcctatagaaacttggcttaccggcattgtcgtctttgcagggct

SEQ ID NO: 47309 - DNA, 201 bp, Homo sapiens
cggagggggaggtgctgagacatcgagggcggaagtgggtgtggtcttcggtccgaaggcctggctgcggggagtgggtgcggcgggagttggggtgatcrttaacatttagactggagctgtttccctggaggtgcgcccttgggaagggcctgactgtgtgaagagtggacagcagtcctccgccccctgctgggctcg

SEQ ID NO: 47310 - DNA, 201 bp, Homo sapiens
tgttcatattaaagttgtcattaataactacttcctcttattaataagttcaagtggggaaggtgggagagcagtattgtctggggatcattgctcaaatrgaagatttggttagactctcctgtggggctcaaggaaactcccttccagtcactcgggtttgaaactttgcttttgaattccttcttattcacatccagt

SEQ ID NO: 47311 - DNA, 201 bp, Homo sapiens
aatcccagctactcgggaggctgaggcaggagaattgcttgaactcgggagccagagactgcagtgagctgataatcgtgccactgtactctagcccaggygacagagcaagactctgtctcaaaagaaaaaaaaaaaaaaacttccactaggcagctcttaaagtcagaggcacttaaaattatgggcgccagccatagg

SEQ ID NO: 47312 - DNA, 201 bp, Homo sapiens
aagtggggaaggtgggagagcagtattgtctggggatcattgctcaaatagaagatttggttagactctcctgtggggctcaaggaaactcccttccagtmactcgggtttgaaactttgcttttgaattccttcttattcacatccagttatcatatttcattgaatctaagataacatcaactttaagatgcggtagta

SEQ ID NO: 47313 - DNA, 201 bp, Homo sapiens
tctcagattcagtaaaaggacagttgggtgagcagagaaggtgatgtggacaggctagtggcaggaggagggactgtagaaagttgacatcccaaatgacrggcaaggaaggaagtcagatcaagaggcagtaagatggctaggaagcaaataaatggtttaaaacaaatggtttaatctctgaatggtaggtataccagt

SEQ ID NO: 47314 - DNA, 201 bp, Homo sapiens
tctccccagactggcccgaagagaggaaaagtgtggaagtccacaagccgcccccgccccgccctcttcgtcgactttcagctgcaccgggaggcggcggygcctggccagagccggggcctggagcctggactagacagcctcgccggccggggcgccagtccagcgccctgcgggcaatgggcttcagcgctcgagcac

SEQ ID NO: 47315 - DNA, 201 bp, Homo sapiens
gttgttcccaaaaggaaactagaagaaaccactagagagaagaaagtttttaggtcctaccttatatgggtttcagttatcctatgtctcacttttcttaytcccacacacacctacccctttatctggcttttagtctcaccctgagtcacagaacttggagtgagaggaagccttaagcgttatctactcttaggtcca

SEQ ID NO: 47316 - DNA, 201 bp, Homo sapiens
caccctctccccagactggcccgaagagaggaaaagtgtggaagtccacaagccgcccccgccccgccctcttcgtcgactttcagctgcaccgggaggcggcggcgcctggccagagccggggcctggagcctggactagacagcctcgccggccggggcgccagtccagcgccctgcgggcaatgggcttcagcgctcg

SEQ ID NO: 47317 - DNA, 201 bp, Homo sapiens; identical to SEQ ID NO: 14182

SEQ ID NO: 47318 - DNA, 201 bp, Homo sapiens
aaactgaaagggagtgtcattatattaatgtgaatatgcagggaaaatagtcataaaccaggccagttcctggaaaacacacatggtcaccctatccctaraccatatgctgtcttgctcggcatccttcttaacactttccgtttttttctgcccctcagactacaccttgtacttctctacatagtgagataaatgata

SEQ ID NO: 47319 - DNA, 201 bp, Homo sapiens
tgggaaatccttgtgggacagagatttgtcttctttgtcttctggaccccaagtattcacaaatcagtattagcacacagttattaatgtgtttattcttscttttttttttttctgagagagtcttgctctgtcgcccaggctggagtgcagtgcatgatctcggctcactgcaacctttgcctcctgtgttcaagcgat

SEQ ID NO: 47320 - DNA, 201 bp, Homo sapiens
tctgtctgtctttcatctcgatctgttgcccaagctggagtgcaatggtgcaacaatttcagcttactccaacctctgccttctttgctcaagccatcatsccacctcagcctctccagtagctgggactacaggcatgcaccaccagactcagctaattttttgtattttttgtagagttggggtttcaccatgttacct

SEQ ID NO: 47321 - DNA, 201 bp, Homo sapiens
agagcctctgcccccaacaccatgaggccctcagccttttctgttatgaggaccaggaggctgtatgcttgatatgtgcaatttcccacacccaccgggcycacaccgttgtgccactggacgatgctacacaggagtacaaggtggggaagcagacacacgatgtcagtgtgggtaaaaagggagaagcggcagaggatg

SEQ ID NO: 47322 - DNA, 201 bp, Homo sapiens
taagttggagacacactatgcccagggtgttagttatcaatagctatattgaaagattccagtcactacaaatagactcgttgctctcttttcaagaagtygttggcctgagctcagcaatatttaatatggttgccataatttatcagttttcagcagttctgagtgtccagatgaacacaagagaaatggaatgttgcg

SEQ ID NO: 47323 - DNA, 201 bp, Homo sapiens
atcataaagctcttataacattaaactttaaaatatggttaatttaagaaatgttaatatttttatgacattttttacttctcagattcctttcttgtctrttagaaacgtatgtcaaacgaggatacagtgtctggaactattggttctaagatataagtggaatgagcctggatcaggagaagtatgctgagctagagt

SEQ ID NO: 47324 - DNA, 201 bp, Homo sapiens
ggtttttttttttttttttttttgagacggcgtctcgctctgtcatccaggctggagtgcagtggtgccatctcggctcactgcaagctctgcctcccggrttcatgccattctcctgcctcagcctcccaagtacctgggactacaggcgcccaccaccacacccagctgattttttttttctatttttagtagagacag

SEQ ID NO: 47325 - DNA, 201 bp, Homo sapiens
ccagcatctcagccacctgcccctctgggtcccttcttgcccttgattccccctgctgcttctcatcgccagccctcctcctccttcttccgcaggcaccrctagacccggccgcggccgcccgccgacaccccagcttccactgacacgagcctcggcgcggcttccgcttccggcgagtattgtgtgtcgcgccgcggg

SEQ ID NO: 47326 - DNA, 201 bp, Homo sapiens
ctctactaaaaatataaaaattagccagatgtggtgttgggcgcctgtaatcccagctcctctggaggctgaggcaggagaactgcttgaacctgggaagyggaggttgcagtgagctgagatcacaccactgcactccagcctgagggacagagtgagattccatctcaaaaaaaaaaaaaaagaaagaaactgaaaggg

SEQ ID NO: 47327 - DNA, 201 bp, Homo sapiens
caccctcaagcctgcctttcattccctatccacttccttctagagtcccagtctctgcttctcactttgcttcatcatcagtcacatgatgcttggggaattctttctttagggagatcactatttgttgtagtggagatgcagaagagaggatgtgctgataattctcagaaagtgttatggctggtgtttgagtcctat

SEQ ID NO: 47328 - DNA, 201 bp, Homo sapiens
accctcaagcctgcctttcattccctatccacttccttctagagtcccagtctctgcttctcactttgcttcatcatcagtcacatgatgcttggggaattctttctttagggagatcactatttgttgtagtggagatgcagaagagaggatgtgctgataattctcagaaagtgttatggctggtgtttgagtcctata

SEQ ID NO: 47329 - DNA, 201 bp, Homo sapiens
ccctcaagcctgcctttcattccctatccacttccttctagagtcccagtctctgcttctcactttgcttcatcatcagtcacatgatgcttggggaattctttctttagggagatcactatttgttgtagtggagatgcagaagagaggatgtgctgataattctcagaaagtgttatggctggtgtttgagtcctatat

SEQ ID NO: 47330 - DNA, 201 bp, Homo sapiens
cctcaagcctgcctttcattccctatccacttccttctagagtcccagtctctgcttctcactttgcttcatcatcagtcacatgatgcttggggaattctttctttagggagatcactatttgttgtagtggagatgcagaagagaggatgtgctgataattctcagaaagtgttatggctggtgtttgagtcctatatt

SEQ ID NO: 47331 - DNA, 201 bp, Homo sapiens; identical to SEQ ID NO: 14172

SEQ ID NO: 47332 - DNA, 201 bp, Homo sapiens
aggccctcagccttttctgttatgaggaccaggaggctgtatgcttgatatgtgcaatttcccacacccaccgggcccacaccgttgtgccactggacgaygctacacaggagtacaaggtggggaagcagacacacgatgtcagtgtgggtaaaaagggagaagcggcagaggatgagatactccctaggtagagatcgt

SEQ ID NO: 47333 - DNA, 201 bp, Homo sapiens
tttttgtttcgttgttttttgtttgcttgttttgagacagaatctcactcacccaggctggagggcagtagtgatcacagcacactaactcaaactccagkgttcaggccatccatcctcttgattctttttgagtagctaggactgcagatgtgcattgccatgcccgactaatttttttttctttttagttgaaacaag

SEQ ID NO: 47334 - DNA, 201 bp, Homo sapiens; identical to SEQ ID NO: 14178

SEQ ID NO: 47335 - DNA, 201 bp, Homo sapiens
gcccacaccgttgtgccactggacgatgctacacaggagtacaaggtggggaagcagacacacgatgtcagtgtgggtaaaaagggagaagcggcagaggrtgagatactccctaggtagagatcgtaagctcctactactcactttgtattctcagagctgcatatgcaggggcacacagtatgtgtgatcagttgtcct

SEQ ID NO: 47336 - DNA, 201 bp, Homo sapiens
aaaaaggaagggagatcaaagattaggtgctggggactgaaaaataattttcatgtattaatactaccaaggatgatttggggaggaagacggagaaacascaaggattatattttcctttgaagagttgctgggacctttcctaggttaggaattgtgtcttctcttatactggtggtataagaacaggaaataatactt

SEQ ID NO: 47337 - DNA, 201 bp, Homo sapiens; identical to SEQ ID NO: 30320

SEQ ID NO: 47338 - DNA, 201 bp, Homo sapiens
ggaaaaaggaagggagatcaaagattaggtgctggggactgaaaaataattttcatgtattaatactaccaaggatgatttggggaggaagacggagaaamagcaaggattatattttcctttgaagagttgctgggacctttcctaggttaggaattgtgtcttctcttatactggtggtataagaacaggaaataatac

SEQ ID NO: 47339 - DNA, 201 bp, Homo sapiens
aacaggaaataatacttattcctcaagggactatctgaggtaaaagacctgttctgttttatcttctgtcagctcctctggtgctatgcctatggtactgrttgagctaaagaagaaaagagaggaggttccctgggagggagtgggaaaggttagtaagaggggactagataggtatgctcatccttaaccttctaggag

SEQ ID NO: 47340 - DNA, 201 bp, Homo sapiens; identical to SEQ ID NO: 30325

SEQ ID NO: 47341 - DNA, 201 bp, Homo sapiens
cagagctcccagcccttctcctcctgctaacccttctcacaccctcaagaggagttagaaaagaggtccttgtcattctcacctcttatggaaaatggaayaagaaataatcatatcctttcttcccacccttctcctgttatttaggatttctgacaaagctggcttgagattggtcacttagagccgactgtctcctct

SEQ ID NO: 47342 - DNA, 201 bp, Homo sapiens; identical to SEQ ID NO: 30331

SEQ ID NO: 47343 - DNA, 201 bp, Homo sapiens; identical to SEQ ID NO: 30332

SEQ ID NO: 47344 - DNA, 201 bp, Homo sapiens; identical to SEQ ID NO: 30330

SEQ ID NO: 47345 - DNA, 201 bp, Homo sapiens; identical to SEQ ID NO: 30333

SEQ ID NO: 47346 - DNA, 201 bp, Homo sapiens
cgtgacaaccgagcccgtgagaaaggcgggggggcggtgctgtttaggggtctgggagatactgggagggaggggacagggattagaagagttgttggagkagctaggcctagggatatgggaggtgtggggttgaatatctagggctgggagaatcggaaggtattggagctatttggagtggcagagatggtgcaggag

SEQ ID NO: 47347 - DNA, 201 bp, Homo sapiens; identical to SEQ ID NO: 30318

SEQ ID NO: 47348 - DNA, 201 bp, Homo sapiens
tctgtcagctcctctggtgctatgcctatggtactgattgagctaaagaagaaaagagaggaggttccctgggagggagtgggaaaggttagtaagagggsactagataggtatgctcatccttaaccttctaggagaaccggagccttaccatcaaacttcggaaacggaagccagagaaaaaggtagaatggacaagtg

SEQ ID NO: 47349 - DNA, 201 bp, Homo sapiens
tgtaggaatcatggtcactttaccaatactgatggggagggcctgttccccattgcaggcctagaatggtttgaatgggagaagtcaggaagtactgtagyagctgtaggggagagaagattctgagagccagaaggcaggaatggatttggttttgagcagggacgtggaaacgtggagaccaggtgaggtctcattatt

SEQ ID NO: 47350 - DNA, 201 bp, Homo sapiens
tgcggggagaagtttcaagaaggttcttatggaaaaaaggctgtgagcatagaaagcagtcataggaggttggggaactagcttgtccctccccacccccrgatcctgcaaaagaggtacaaagcttcccagagggccacagggcccagaccagagtcaagcctcttgttttaggagaaacctcagtggacaggcagggta

SEQ ID NO: 47351 - DNA, 201 bp, Homo sapiens
gtaaaattagcaaggcacactctttgccagtcaacccacggtcctgagatgtttacggcagaggaagcatcttggtaaagtctgcaaggacaaacttgccsctatatcacaggacaagatctgcttttaagatgattatactcatgctttgatgtacttaacacactgaaatgaaattctgattcagctgtagaatcccat

SEQ ID NO: 47352 - DNA, 201 bp, Homo sapiens
tgtgacaaagtttttgtgcactgtggggtgtaatgatttaaatactaaaactagaaattttgtgtagcaaatgagctcaaaatactacaaagctgcattartgttcaattgagacatgaatatgatgttttatcactgtgttaggtacctagaatagaacaaaataaaagatggatactgttttcaaggagattaccatct

SEQ ID NO: 47353 - DNA, 201 bp, Homo sapiens
tatatatatgaaatatttgtaaccacattaccccatcttgagcttgcttgcctcttcctggtttttgtttcttgttatttgcattcttgaatggcaagagraagtgcaaaaaacaagggtaaactttaaagggaccatgaggcaaggaccgactgtagaatgggagagaccacagcaggctctccatcatctcccacagcg

SEQ ID NO: 47354 - DNA, 201 bp, Homo sapiens
aggaacgctttgtctttggaccaaggtgagctctcggagacgcatgtctgctgtaccgtgccttctttctgatgcttgaaatgttctcaagtcctggcacrccatacacgaatgtaatgatgcattttttaaaataccagagcaaatactttgttttatctttgccgatgaaactgtagtacatggctagaaaccttgcaa

SEQ ID NO: 47355 - DNA, 201 bp, Homo sapiens
tgggaagccccttagaaagtgcaggaagggaacacgtatagaatttgagttttttgtctgaaggggttgtttttttctttggtcattatggtgacttaggrtttgcaagatggaactaatgcgtgacttaacatatattatttggattgctaatatttcagttaccacgttccaagtacctttcaaatgaaagcttttgct

SEQ ID NO: 47356 - DNA, 201 bp, Homo sapiens
aagtgcaatggcacgatctcagctcactgcagcctccgccacccaggttcaagcgattctcctgtctcagcctcccgagtagctgggattataggtgcccmccaccacacccatcttctttttgtatttttagtagagatggggtttcaccatgttggccagactggtctcgaactcctgacctcaggtgatgcaccgccc

SEQ ID NO: 47357 - DNA, 201 bp, Homo sapiens
tttcgggttgaacctgtggacgtgctccgggcgcgctgttagttgccgccccagacctaggaggcgagtcgggtcggctcaggggagcggggtttgggctyggagtctccagtggacctgccggactcgctcctcacccctcaccctttgccgtctcacgcgtggcgtcatcctagggtcattgctgcccatgagctgcta

SEQ ID NO: 47358 - DNA, 201 bp, Homo sapiens
tgctttccacggagcgttgcacctttggaaacagaatacagttaacccagtaagaaaagagtgtttaaataaagcatttctaatcaaatagagtacattcyaggtaaatagtattttgcttataacactctacagaaacatagtagaggcacttgaagttcaagtgacataacttttttctgtagacattgttaaggtatt

SEQ ID NO: 47359 - DNA, 201 bp, Homo sapiens
ggaatactttgggattttatgattgccagttcaatgaagatggctccatgatcattgctcatgctttccacggagcgttgcacctttggaaacagaatacwgttaacccagtaagaaaagagtgtttaaataaagcatttctaatcaaatagagtacattctaggtaaatagtattttgcttataacactctacagaaaca

SEQ ID NO: 47360 - DNA, 201 bp, Homo sapiens
ctgtctgttattgtacaggttcgagtaggtgaagtaggtgggaatactttgggattttatgattgccagttcaatgaagatggctccatgatcattgctcrtgctttccacggagcgttgcacctttggaaacagaatacagttaacccagtaagaaaagagtgtttaaataaagcatttctaatcaaatagagtacattc

SEQ ID NO: 47361 - DNA, 201 bp, Homo sapiens
ggacagttgggacactgtgaagaactactttagagcaatgacgaagataacaatttcatgctaagttaatcactgttgtccccctcccttaaaaacagatrcgtggttgcagtaggattggagtgtggaaagatttgcttatatacctggaaaaagactgatcaagttccagaaataaatgactggacccactgtgtagaa

SEQ ID NO: 47362 - DNA, 201 bp, Homo sapiens
cctgggctgatgcctgcagagtcttttgtaaggcagggacagttgggacactgtgaagaactactttagagcaatgacgaagataacaatttcatgctaarttaatcactgttgtccccctcccttaaaaacagatacgtggttgcagtaggattggagtgtggaaagatttgcttatatacctggaaaaagactgatcaa

SEQ ID NO: 47363 - DNA, 201 bp, Homo sapiens
tttgtcaatgttattaaaaatgaatatagatcaaatgaattggagggtaaggaaacaaagtattgttttttttctggaaaatctggaaatatatatattayagacaaaaaagtcttatacataaacttcacaatataatgttttaaaattaatacaacttattttttaattaggtagagatcttttcctagcaagctgttc

SEQ ID NO: 47364 - DNA, 201 bp, Homo sapiens
actgggtaaatgcagttcactggcaacctgtgttttacaaaggtaggaagaaaaccatacacatatcccttactccagttaaatcttatggcacagtaagytgaccaaatcaagtggagaatttttttactgtgattagaaatctcaaatacatgacattttcaagttgacaaagtataatactgcattcctggtctgctg

SEQ ID NO: 47365 - DNA, 201 bp, Homo sapiens
gagatcgaacctggtcattgtggaaaaagcaggatacaatctcacctgagttcggtaaaacagcttctgattgggaaagttattagtgaaacagttatgtycattttatctacattaagcagctttagttaagagaaagataacagagtgaagggtagagcctcatgtctttgaagcctttcaaagttcgtggataactga

SEQ ID NO: 47366 - DNA, 201 bp, Homo sapiens
tgtctcactctgttgctcaggctggggtacagttgtgcagtcatggctgactgcagtcttgacctcctgggctcaatcgatcctcccacctccacctcccragtagctgagactacaggcaggcaccgccatgcccggctaatttctattttttgtagagacggggtttcaccatgttgcccaggctggtctcagactcct

SEQ ID NO: 47367 - DNA, 201 bp, Homo sapiens
gtaacacgtggtagattcaaataaatagagttgagaacattgggaacagcatctatagtcaactgaaaaacaagtcaaatgattttgagtgatttttctgyggctcttggtaatttttaccaatactgcccagttgtggtttattcatggatgaatatttgccccatggttatatttccattgtatagtaaataattttca

SEQ ID NO: 47368 - DNA, 201 bp, Homo sapiens
cccttcatgcttttatctccccttattttagacaaccgatgtttcaatcgtccatttctacttctctgtcaaactgtgactctaaggaggagatatctctrcccattgttggacattatgagctgtacagtgtatctttggtctgaagaaatgatggtcggccatccagatctatttaatatcttctgttctggttttttt

SEQ ID NO: 47369 - DNA, 201 bp, Homo sapiens
gtttctgatagaaattcacggaactgactgtgggtcagtccgtaagagctagtgaagtttgccactaacactactgcttgagtaacacgtggtagattcarataaatagagttgagaacattgggaacagcatctatagtcaactgaaaaacaagtcaaatgattttgagtgatttttctgcggctcttggtaatttttac

SEQ ID NO: 47370 - DNA, 201 bp, Homo sapiens
tgttgtttgttgtttttttctggtcatctacaaacatgatgatggttgatcacctaaagggattaggttttattttttagatggtgtcctacagcagccartgagattattatctgcttccatggataaaaccatgattctctgggctccagatgaagagtcaggagtttggctagaacaggtaaaaatgttggatattta

SEQ ID NO: 47371 - DNA, 201 bp, Homo sapiens
ttttcattatattgtttgaaaggtcaaaatactgatttcattatctttatttctgcatttatccttttaaaaaatgggatttgtatttgtccattcttacrcttctataaagaacttcccaagactgggtaatttgtaagagaaagaggtttagttgactcacagttctgcaaagctgaggaggcctcaggaaacttaaat

SEQ ID NO: 47372 - DNA, 201 bp, Homo sapiens
cagtatccctggatggtagatcctgttgggatgttgtatttgaaagagatatttttggatgtgacagttataaaggtagttcagtgaacattgttcacctrggtgtattctgttttttgttactattcttggtggtaaagtccatcagagttgagattttggtaacagttttatggggagaacgaaaaaatgatataacca

SEQ ID NO: 47373 - DNA, 201 bp, Homo sapiens
ctaaagtgttgggattacaggtgtgggccaccatgcttggcctgatactttgtattttcctatttttatgtgagaatgagtcatttttcatatgtgaaatrtttttcttctaaaccatattagtaagatttttaaaattgctgaggataatgtttagtgcttctcattaaagtaatttgtaaaatattactaaatttgcag

SEQ ID NO: 47374 - DNA, 201 bp, Homo sapiens
ttggcatgaaattgcaaggcctcagatacatgggtatgacctgaaatgtttggcaatgattaatcggtttcagtttgtatctggagcagatgaaaaagttmttcgggttttttctgcacctcggaattttgtggaaaatttttgtgccattacaggacaatcactgaatcatgtgctctgtaatgtgagtatttctctaaa

SEQ ID NO: 47375 - DNA, 201 bp, Homo sapiens
tttgccccatggttatatttccattgtatagtaaataattttcatctaataatttgcttattgaaaattcagcttttgaatgatcatttttgtttatcccrttttacccaggtgacttggcatgaaattgcaaggcctcagatacatgggtatgacctgaaatgtttggcaatgattaatcggtttcagtttgtatctgga

SEQ ID NO: 47376 - DNA, 201 bp, Homo sapiens
agtgatttttctgcggctcttggtaatttttaccaatactgcccagttgtggtttattcatggatgaatatttgccccatggttatatttccattgtatartaaataattttcatctaataatttgcttattgaaaattcagcttttgaatgatcatttttgtttatcccgttttacccaggtgacttggcatgaaattgc

SEQ ID NO: 47377 - DNA, 201 bp, Homo sapiens
tgttggttcaggaagtgaaagtacgggtagacatccacacaagatggtctttaaactgtttctcagcatttatgagcgtgacttttttgtagtgcctgaartaacagtaacttttagttttaaaattagcaaataaaactttagcatttataacttagatattatattttctattctagcaagatagtgatcttccagaag

SEQ ID NO: 47378 - DNA, 201 bp, Homo sapiens
gcggctgaccagttggcgacatggtggcacccgtgctggagacttctcacgtgttttgctgcccaaaccgggtgcggggagtcctgaactggagctctggscccagaggacttctggcctttggcacgtcctgctccgtggtgctctatgaccccctggtaagagaggtcgctggacggccgacccttgtgcttttcgggt

SEQ ID NO: 47379 - DNA, 201 bp, Homo sapiens
gcaaattttatgccacattttcatggagagggacatatatctgtattcgtcgtgtctaccactttgttttgtggtaatctgaaattgatacatgtggtaawctgaaattgatatattgcacttgatttttaaaagtttgcttgaccaaattgcttgcatgcataatattatttttataaacaaccatttgagatgaaagtg

SEQ ID NO: 47380 - DNA, 201 bp, Homo sapiens
tattgccagtgagtaagattaaaatttagtcttgcagttttaagtaaatatagtaaaatattttccaggttaaaataaaatggctaaaatgttaatgatgygattttaaaacctgtacatttcaattttcaggttttaacttccattcatgtttacaccattaattggaaaaacatttcatgatttctctatctttgtttt

SEQ ID NO: 47381 - DNA, 201 bp, Homo sapiens
aactcctgacctcaggtgatccacccacctcggcctcccagaatgctgggattacaggcatgagccaccgcgcccagcccaaaagctgattagttcttaakcattttgtggtagcttcttggggaagtgcatgagcctactgatgggactccactggatcagaaccaatttgtgagtatagaaggcatgttagacacctct

SEQ ID NO: 47382 - DNA, 201 bp, Homo sapiens
ctctgtggtctctgggcaggaacgctttgtctttggaccaaggtgagctctcggagacgcatgtctgctgtaccgtgccttctttctgatgcttgaaatgytctcaagtcctggcacaccatacacgaatgtaatgatgcattttttaaaataccagagcaaatactttgttttatctttgccgatgaaactgtagtacat

SEQ ID NO: 47383 - DNA, 201 bp, Homo sapiens
ggggtttcactatgttggccaggctggtcttgaactcctgacctcaggtgatccacccacctcggcctcccagaatgctgggattacaggcatgagccacygcgcccagcccaaaagctgattagttcttaatcattttgtggtagcttcttggggaagtgcatgagcctactgatgggactccactggatcagaaccaat

SEQ ID NO: 47384 - DNA, 201 bp, Homo sapiens
tgtcatccaggtgtgatcatagctcactgcaacctcattctcctggggttaagccatcctcacgcttcaacttcctgagtagctgggactacaggtgcacmtcaccacacccagctaatatctaaaattttttttatagacacagggtcttgctttgttgccctgcctagtcctgaactcctggcttcaagtgatcctccc

SEQ ID NO: 47385 - DNA, 201 bp, Homo sapiens
atttaaaatatttgagattacaaatattatattatctactcagaggtgctccagttagtgatttagatattacgtgatgggtttttcattcccaaaggaaygctttttcttgtctaatcaaatagtgttctcagtaaaagagcaacgcagtaggactgtctgagaccaaatgatgtcactggtatacatgaagatgttaaa

SEQ ID NO: 47386 - DNA, 201 bp, Homo sapiens
tgtttttttctttggtcattatggtgacttaggatttgcaagatggaactaatgcgtgacttaacatatattatttggattgctaatatttcagttaccamgttccaagtacctttcaaatgaaagcttttgctagtaataagatttacagaggtaatataagcaaacactaccctttaggttggtttgccaaactcccta

SEQ ID NO: 47387 - DNA, 201 bp, Homo sapiens
ggttcacttactagctatgtgtccttgaggacattagttaatccctgtctcaggttcctcatttgtaaaacatgggtagtttttttttttttttttttttsttttaacaggatcttactctgtcatccaggtgtgatcatagctcactgcaacctcattctcctggggttaagccatcctcacgcttcaacttcctgagta

SEQ ID NO: 47388 - DNA, 201 bp, Homo sapiens
taaaggagagaaatttagaaaggggttggttaactctaaactcatttatttaataggatactcatttctttgcattctataagaaggttaaaaatggttgkgaaagtccagctattcaacttttttttttttttttttgagacagagtcttgttctgtctcctaggctggtgcagtggtgagaacatgcgtcactgtagtc

SEQ ID NO: 47389 - DNA, 201 bp, Homo sapiens
gggaggtaggggaataagggaaaaactattttctagttttcttacttttatgaatttaacatttttctgtaataaatgattgttaccttttcatttggtgmtagaagtgggtggagtatgactgacccaagctttaaaaaaagtcaaaacaaagtagctaggaattttttttttttttttgagacagggtctcgggtgcag

SEQ ID NO: 47390 - DNA, 201 bp, Homo sapiens
ttttgctgcagaagacatgatttcattgttttttatggccgagtagtagttcatggggtgtgtgtgtgtgtgtgtgtgtgtgtgtgtgtgtgtgtgtgtgkatacaccacattttaaaaatccaattatccattgatggacactgaacagttttttatataccctggatacaactttatcacatgtgcttatgtagatatt

SEQ ID NO: 47391 - DNA, 201 bp, Homo sapiens
actatatccagattatagaattttagggaatgttctaatctaaaccaaaataatccaatagaatctttttttgacagtcctctgttaagatggttgtctaytctgaacaccaagtaaccgctgccttgaccatcaggctcagagttgttagggggaaacaggtcattaggtgggggaggagagatggaagatgctgtggta

SEQ ID NO: 47392 - DNA, 201 bp, Homo sapiens
tcaagtggagaatttttttactgtgattagaaatctcaaatacatgacattttcaagttgacaaagtataatactgcattcctggtctgctggacactcarttccattgaacattgaactcctaagtgggaaaagtgtaattcctgccatgatgctgaaactaccacacccccagtaactttttatcttaaaagtttccac

SEQ ID NO: 47393 - DNA, 201 bp, Homo sapiens
ttgctaatgcacatacaatgggaacaaatatgtgttacttccaagaaagcagccttttttgttttaatttttaagttttctttgtatgttatgtttttctrttgtcccaattagaaaggaggatgcttatctcttctgttgttagttggatggtagatgattaaataaattggtatttatcagatgacattagctgtcttg

SEQ ID NO: 47394 - DNA, 201 bp, Homo sapiens
gattcagcttttaaaagcagtgcatcttcaaggccatgaaggacctgtttatgcggtgcatgctgtttaccagaggaggacatcagatcctgcattatgtmcactgatcgtttctgcagctgcagattctgctgttcgactctggtctaaaaagggtccagaaggtaggtttggagacatgataatccagacaaatgaaat

SEQ ID NO: 47395 - DNA, 201 bp, Homo sapiens
caagtaactgggactgctggcacacaccactgcacctggcttaagtgttttttccaagaagtcaaaggctaatgattctaaagaaagttagtgtacagacmcttatacatgagtattatgtgcatcttctttagtggcagaattctgttttaagtattataattggaaaaacaactgaagagacatttaaggaacaccact

SEQ ID NO: 47396 - DNA, 201 bp, Homo sapiens
taatataggagaacgtttttgtccttaggagatatatggtctttgaggatcagagatcacagtgtctgccacttatttttaagtagtttgcctcctaaaargtgtgtgtgtatgtatatagaggaagagtgagatattaagcaaatatggcaaaatgttaccagtttgtgaatctaggtagagggtacaggggtattgttt

SEQ ID NO: 47397 - DNA, 201 bp, Homo sapiens
agaagttgcaagtatttaaaagatctattttgaagtgtgtctctaatttcaacaataagtcatattcttggtagtagcacctgactacaatgtttcatatratgttcctgccaagagtgtttagcctgcatctaatcatgaggaaacaatcaaacagattgagggacattctgcagaacaactgctgggtactgtcattgt

SEQ ID NO: 47398 - DNA, 201 bp, Homo sapiens
cattttagagaaagtgtcagtttgggggaaaggtcataggggatggggatcctaagcactgattataaggcgggacttccctcgacttcacccagtcagtyggttattttcttggtgctttcctcaccatatttctcaagtgaatagtttttgcatgctccccggaattcattataactccattcccaatggctaagttgg

SEQ ID NO: 47399 - DNA, 201 bp, Homo sapiens
ttcttcaaactaggagatatagcttctcagccttctgatgaagaggagctgttaactagtactggttttgagtatcagcaggtggcctttcagccctccayacttactggtaagatgtgacaaagacaatttaataaatcgctagaacacacagtatgttatctattgctgctgacctaaataagtgctatagaattcact

SEQ ID NO: 47400 - DNA, 201 bp, Homo sapiens
agagcctcccactgaggatcatcttctgcagaatactttgtggcctgaagttcaaaaactgtaagttaaactgtatttagctctttggtctgattctgtcrtaacttctgacttttcctccccaccccacaatctgatgtctcctttttcttccttctacctacctttttcctcctcttctatatatctcttagtggctct

SEQ ID NO: 47401 - DNA, 201 bp, Homo sapiens
ttccatgttttattgtttagatactggctggttgaaagtaggaggtgaaaacttgtatgttaattgtttgaatgagttatattacttataggaagctgacrtttttctcccatctccctgtctttctctcaaatgtttgcctagacaaacatacaatgttccttaaaagaattgtatattagctagagaggttgatgttat

SEQ ID NO: 47402 - DNA, 201 bp, Homo sapiens
atttcatgatttctctatctttgttttagccaaagtcatacactggctatcagaaaattatgctggaagaattgcagtggaaaaactgaacagaaggaagyagaaggtgctgagtggttacactttgcaagctgtggtgaagatcacactgtgaagatacacagagtcaataaatgtgcactgtaatggacttaataacta

SEQ ID NO: 47403 - DNA, 201 bp, Homo sapiens
gctgcctaggtgaaaaggatgtgggcactgtaggagagtgagcagaagcaggtgggtggatgcagacgcgagagctcagtgtaatgggaggacaggatgcygggaatgtggagtctcaagaaaggcaggactgatttagaggaatggatgacttaagccatggttaaaagtttatagattgaagaaggcaaatctgtttga

SEQ ID NO: 47404 - DNA, 201 bp, Homo sapiens
agccatggttaaaagtttatagattgaagaaggcaaatctgtttgatgtaaacctgatctttttactagcatcgaaaacactgaaatctgcttttacttayttattaatttttctgtaggataaattccagtttactaactgtattttcttctctaaagaaaagggttgttgttaccaacttgaatggtcacaccgcccga

SEQ ID NO: 47405 - DNA, 201 bp, Homo sapiens
aacgtttttgtccttaggagatatatggtctttgaggatcagagatcacagtgtctgccacttatttttaagtagtttgcctcctaaaaggtgtgtgtgtrtgtatatagaggaagagtgagatattaagcaaatatggcaaaatgttaccagtttgtgaatctaggtagagggtacaggggtattgttttttggtgtagc

SEQ ID NO: 47406 - DNA, 201 bp, Homo sapiens
atcttctttttgtatttttagtagagatggggtttcaccatgttggccagactggtctcgaactcctgacctcaggtgatgcaccgcccctccccccccccgcctcccaaagtgctgggttataggcatgagccactgcagccggcctcttcttattttactaatgtgtttaaaagaaaacatccatgaacacaagaaaag

SEQ ID NO: 47407 - DNA, 201 bp, Homo sapiens
gattcagttgtctgtcctctacacctgtaactctttttacttaataaagccatcaggtccacatgcagaacccactgactcgttttacacaatatttttasattttatacaatttttatttagtttaataaatacatagaacctagtgtatactagaattgtcctgtgtactttacaaaagtaactcatttaatcctcata

SEQ ID NO: 47408 - DNA, 201 bp, Homo sapiens
tcaaaactttttgtaaactcccattagtgctaactttagaatcagtttttgttcacagagggagtaacattttttgtcacaggctttttttttttttttttggccagacataatatagtttagtcacagacttatccatcagattaggttttgaatgacctattagctatttatacacatttaattttcctctaaaggtta

SEQ ID NO: 47409 - DNA, 201 bp, Homo sapiens
agtagctgggattacatgcacccaccaccatgcccggctaatttttttttttgtatttttaggagagacggagtttcaccatgttggccaggctggtctcaaactcctgaccgcaagtgacccaccttcctcagcctcccaaagtgctgggattacaggcctgagccaccatgcccagccagttctggttttttaatggtt

SEQ ID NO: 47410 - DNA, 201 bp, Homo sapiens
gagtagctgggattacatgcacccaccaccatgcccggctaatttttttttttgtatttttaggagagacggagtttcaccatgttggccaggctggtctcaaactcctgaccgcaagtgacccaccttcctcagcctcccaaagtgctgggattacaggcctgagccaccatgcccagccagttctggttttttaatggt

SEQ ID NO: 47411 - DNA, 201 bp, Homo sapiens
tgagtagctgggattacatgcacccaccaccatgcccggctaatttttttttttgtatttttaggagagacggagtttcaccatgttggccaggctggtctcaaactcctgaccgcaagtgacccaccttcctcagcctcccaaagtgctgggattacaggcctgagccaccatgcccagccagttctggttttttaatgg

SEQ ID NO: 47412 - DNA, 201 bp, Homo sapiens
tgtctcagccgcctgagtagctgggattacatgcacccaccaccatgcccggctaatttttttttttgtatttttaggagagacggagtttcaccatgttrgccaggctggtctcaaactcctgaccgcaagtgacccaccttcctcagcctcccaaagtgctgggattacaggcctgagccaccatgcccagccagttct

SEQ ID NO: 47413 - DNA, 201 bp, Homo sapiens
tgactacaatgtttcatataatgttcctgccaagagtgtttagcctgcatctaatcatgaggaaacaatcaaacagattgagggacattctgcagaacaastgctgggtactgtcattgtcacaaaaatgagggggactaggaaactattctacattaaaggagactaaaaagatttgatatccaaatgttgagtgtattt

SEQ ID NO: 47414 - DNA, 201 bp, Homo sapiens
caaaggactccagcccttttgtcagtagtttccccccctattgccccacgccagatcagatttttcactgtagtctctgccttccagctttttttttttttctctttttttgagacagtgtctcactctgttgctcaggctggggtacagttgtgcagtcatggctgactgcagtcttgacctcctgggctcaatcgatcc

SEQ ID NO: 47415 - DNA, 201 bp, Homo sapiens
acattggtggcaaggcatgtccttagaaaaagtctcttatctagcagagtcatcagggctgccctttggtaatgcaaattattaatgattttttatcttaytaaaataattttacagtcacatctttcatagctttttaaaattttaaaatttaaaatttatttatttattttttagagacaaagtctcattctgtcactc

SEQ ID NO: 47416 - DNA, 201 bp, Homo sapiens
aaaatggtattcccagtgaaatatctgaactgtatttttacttcgtagcagttgaagcttggattatacagcagtgcttaggatgagggtagtgcagcccwagactttggcaggatcctgtcccacctccccagttgcctgtaacctttattaaaagaacttgtaagcagggcctagactgaggctgtgttttagagactt

SEQ ID NO: 47417 - DNA, 201 bp, Homo sapiens
gtttttgtccttaggagatatatggtctttgaggatcagagatcacagtgtctgccacttatttttaagtagtttgcctcctaaaaggtgtgtgtgtatgkatatagaggaagagtgagatattaagcaaatatggcaaaatgttaccagtttgtgaatctaggtagagggtacaggggtattgttttttggtgtagcttg

SEQ ID NO: 47418 - DNA, 201 bp, Homo sapiens
ccttatatgatgttatgcaattggagaaacaagaaaaatggtattcccagtgaaatatctgaactgtatttttacttcgtagcagttgaagcttggattakacagcagtgcttaggatgagggtagtgcagccctagactttggcaggatcctgtcccacctccccagttgcctgtaacctttattaaaagaacttgtaag

SEQ ID NO: 47419 - DNA, 201 bp, Homo sapiens
tggtcacaccgcccgagtcaattgcatacagtggatttgtaaacaggatggctgtaagtaataaccagattttaaagttgatctcaattgttttctgatamaataaggttagccatttttttctcatcacttctcttaatttagcattaccttatatgatgttatgcaattggagaaacaagaaaaatggtattcccagtg

SEQ ID NO: 47420 - DNA, 201 bp, Homo sapiens
tttcttctctaaagaaaagggttgttgttaccaacttgaatggtcacaccgcccgagtcaattgcatacagtggatttgtaaacaggatggctgtaagtawtaaccagattttaaagttgatctcaattgttttctgataaaataaggttagccatttttttctcatcacttctcttaatttagcattaccttatatgatg

SEQ ID NO: 47421 - DNA, 201 bp, Homo sapiens
ggatgacttaagccatggttaaaagtttatagattgaagaaggcaaatctgtttgatgtaaacctgatctttttactagcatcgaaaacactgaaatctgyttttacttatttattaatttttctgtaggataaattccagtttactaactgtattttcttctctaaagaaaagggttgttgttaccaacttgaatggtca

SEQ ID NO: 47422 - DNA, 201 bp, Homo sapiens
atgagccaccacacctggcctcgattgggcttttaagtaaatatgggaataaaagcatttcaaatgctaaaataaagttttgggaatgatgctcattcagsaaatcttcgacgaccatctgtgggctagccctgggctgagtgatgatgacacaaggtaatgagtgataacgcgcgtggccaccaaggaattctcagtcta

SEQ ID NO: 47423 - DNA, 201 bp, Homo sapiens
agagtacattctaggtaaatagtattttgcttataacactctacagaaacatagtagaggcacttgaagttcaagtgacataacttttttctgtagacatygttaaggtattgaaatttgcatgtaggtaaatttgctacgtaagtgcactgtattcctttaagctatagaattttttaatgataatttttctgaaatgtg

SEQ ID NO: 47424 - DNA, 201 bp, Homo sapiens
aaagcaggatacaatctcacctgagttcggtaaaacagcttctgattgggaaagttattagtgaaacagttatgtccattttatctacattaagcagcttyagttaagagaaagataacagagtgaagggtagagcctcatgtctttgaagcctttcaaagttcgtggataactgaggaagacttgaccttccttgtaaga

SEQ ID NO: 47425 - DNA, 201 bp, Homo sapiens
aagaaaagagtgtttaaataaagcatttctaatcaaatagagtacattctaggtaaatagtattttgcttataacactctacagaaacatagtagaggcasttgaagttcaagtgacataacttttttctgtagacattgttaaggtattgaaatttgcatgtaggtaaatttgctacgtaagtgcactgtattcctttaa

SEQ ID NO: 47426 - DNA, 201 bp, Homo sapiens
gggttgaacctgtggacgtgctccgggcgcgctgttagttgccgccccagacctaggaggcgagtcgggtcggctcaggggagcggggtttgggcttggartctccagtggacctgccggactcgctcctcacccctcaccctttgccgtctcacgcgtggcgtcatcctagggtcattgctgcccatgagctgctagtaa

SEQ ID NO: 47427 - DNA, 201 bp, Homo sapiens
tttgcttagaaatcatccctgctgttccagtacttgttgttgcaggcctggtcctggaccactgcatcaggtagaggagaaaaaataaattaaaaaaaaawtttttttgaggcgatttggggaagaaagaaaaaaaatatagtcattttaccagtgtattcctcctttggtaagaaccgcatagtcataccagcatcctcc

SEQ ID NO: 47428 - DNA, 201 bp, Homo sapiens
ataagaaatggttgtagtatgttatctcctaggaattttttttggaattcaaacagataaataaaatatactcatagaaacaatgtgttgtttttaaaatrttttctcttcagtttatttttacttactagcttcattgtttcatctctgtcctataggcagctaagaaagagcatgcagctatcattctttggaacacta

SEQ ID NO: 47429 - DNA, 201 bp, Homo sapiens
tctggccctcggctggctgcgaaacgtggactgggtgatgcctcaggagaaaccaccctagtagttccgctccgagggcggaagtgcgcgtctcttgtttstgcggctgaccagttggcgacatggtggcacccgtgctggagacttctcacgtgttttgctgcccaaaccgggtgcggggagtcctgaactggagctctg

SEQ ID NO: 47430 - DNA, 201 bp, Homo sapiens
cacttgagcccaggaggttgaggctgcagcaagccataatcacaccattgcactccagcctgggtgagtgagagcctgtcccccccaaaaaagtataaacrttcagaaagctactaatatcattctgtgttatattttcttaggctttttcaaccttcgtatatctgtactgttgaaaatacaatttcaaatagcaatttc

SEQ ID NO: 47431 - DNA, 201 bp, Homo sapiens
ttaaggggggcttattaggattttgatagccattgataatttaaatgacttactgtgtacccaagattgatactgttatcaaatatactgtggatgtatayaggtctaatttgaggaaagaatctaattctttagaaggtgaaggtctggggtaagttgaaaaagtgttgaatgaagatggcatatgagcatttctctcaa

SEQ ID NO: 47432 - DNA, 201 bp, Homo sapiens
tgctaggttcaagcgattctcctgccttagcctccctagcagctgggattacaggcacccgccaccacgcccagcttattttttgtatttttagtagagayggggtttcactatgttggccaggctggtcttgaactcctgacctcaggtgatccacccacctcggcctcccagaatgctgggattacaggcatgagccac

SEQ ID NO: 47433 - DNA, 201 bp, Homo sapiens
ctatgaaacaagatgtgaataacatactttccttataatattcaaatgatctgagtatagaacataaagttaaggggggcttattaggattttgatagccrttgataatttaaatgacttactgtgtacccaagattgatactgttatcaaatatactgtggatgtatataggtctaatttgaggaaagaatctaattctt

SEQ ID NO: 47434 - DNA, 201 bp, Homo sapiens
aaatgatcaggtaataatgtttatattaagaggctggaattatattctgcttagttatatctcaatacagactatatccagattatagaattttagggaawgttctaatctaaaccaaaataatccaatagaatctttttttgacagtcctctgttaagatggttgtctactctgaacaccaagtaaccgctgccttgacc

SEQ ID NO: 47435 - DNA, 201 bp, Homo sapiens
tctttgccgatgaaactgtagtacatggctagaaaccttgcaaagagaaggctttacagtgtgtgatctgtctgtattaggtggttgtctggggtgagtgygactccactgatgactgtattgagcacaacattggcccctgctcctcagtcctggacgtgggtggggctgtgacagctgtcagcgtctgcccagtgctcc

SEQ ID NO: 47436 - DNA, 201 bp, Homo sapiens
gctgtcagcgtctgcccagtgctccacccttctcaacggtcagtctctgtgtggggcttagttttaagaggaccacttggtttcttaatatgtagccctcrtgtcatttcatttgtgaattctcctagcctctgagttactgtcttttttttctttttttttttttgttttgagatggagtctcactctgtcacccaggct

SEQ ID NO: 47437 - DNA, 201 bp, Homo sapiens
  misc_feature (1)...(201): n = A,T,C or G, or insertion/deletion polymorphism (see Tables 1-2)
aattggaaaaacatttcatgatttctctatctttgttttagccaaagtcatacactggctatcagaaaattatgctggaagaattgcagtggaaaaactgnacagaaggaagcagaaggtgctgagtggttacactttgcaagctgtggtgaagatcacactgtgaagatacacagagtcaataaatgtgcactgtaatgg

SEQ ID NO: 47438 - DNA, 201 bp, Homo sapiens
ttcttgaaaaattcttttcaacttagaggacctatttctggctcagccattttattggcacatttatccaattaaataaaggtaaaaaaaatccttttttycacaatgcttctgtcattctttctgattcagcttttaaaagcagtgcatcttcaaggccatgaaggacctgtttatgcggtgcatgctgtttaccagagg

SEQ ID NO: 47439 - DNA, 201 bp, Homo sapiens
tagtgaattttagcatattgacaaagaagtgttgagcctaaaaagtactttgtcctgttaaatatttgctggtcgggctttttttttttttttttttttttggagtgtagtgacagtaactgctcagtgcaacctgcaacctccacctcccgaaatcaagtgattctcgtgcctcagcctccctagtagcagggattacag

SEQ ID NO: 47440 - DNA, 201 bp, Homo sapiens
gttccgccatggctgggcactgggaggaccctaagaggggcggccataggggtggagttgtcagggaagcaggagcccgggagagccagggtgacaccctkttaaaatcaactccgtcgtaaaattagcaaggcacactctttgccagtcaacccacggtcctgagatgtttacggcagaggaagcatcttggtaaagtct

SEQ ID NO: 47441 - DNA, 201 bp, Homo sapiens
acagcgagactgtctcaaaaaaaaaatttacaattaatgtctgcatatccttcacctaggttcataaatttgtacttttgctttatctacttgcctttttytctctctctacacacacacacacacacacacacacacacacaattagttgaatgaattgagagtaagttgcagaaaacatgacactttactccaatattg

SEQ ID NO: 47442 - DNA, 201 bp, Homo sapiens
cttgataaaatcttctagaattagaaatttcagggtaaagaacttttttttgcttcgaatgctttggccatctctacattagaaagccttggccgggcacrgtggctcatgtccgtaatcccagcactttgggaggccaaggtgggcggatcacgtgaggtcaggagtttgagaccagcctggccatcatggcgaaacccc

SEQ ID NO: 47443 - DNA, 201 bp, Homo sapiens
gtcagccaggctggaatgcaggagtgccatcataattcactgcatccttgcactcctgggcccaagggatcctcctggatcctcctgcctcagcctctcargtggctgggactacaggtatgtgccagtgcacctagctaatttattttttaaacaattattactattttttttgtagagacagaatttctcagggctggt

SEQ ID NO: 47444 - DNA, 201 bp, Homo sapiens
tggactgtactggaagcctggtgccagcatccacttctgctgaggcctcaggaagcttctaatcatggcagaaggtgaagagggaacgtggagagagaggragcaagagagagaaggaaggagtcccaggcttatttatttattttattgttgtttttcattttttgagacagggtcttgctctgttgcacaggctggggt

SEQ ID NO: 47445 - DNA, 201 bp, Homo sapiens
gatttatcttgcttcattctgaaccttatcaagaggatctgactgagagcccactgcagttagagctgagcacttttgaaaagcttgtccatcactctagyagggagaggctctggacagatgaataccttttcttcggcttgtgaggcttcccactatttattactgaactattatgttaatgaagatggacattttagg

SEQ ID NO: 47446 - DNA, 201 bp, Homo sapiens
aactatttttagtgtgtggtcgagtagtgttaagtgtattcccattgttgtgaaattgatctgcagaactaagaccctgcacccgtaaaacaagaactccscatttccccctttcccagacccttgtaactacttccactttctttcctttttttttttttttaatttattttatgaaagatgaggtcttgctctgtcagc

SEQ ID NO: 47447 - DNA, 201 bp, Homo sapiens
gtcatgggaggttgtgcccttgagcccccggtccccaagtgtgtgttgcctactcctgctgggaaattggagcagcctttggggggaaaaaaaagaaaaactctctgcagtttgttctccatgtcaggaggtggctggtgggttttgtgaatggcgccgtaatcttttcatactcatcttctctgtgagggcagggacttg

SEQ ID NO: 47448 - DNA, 201 bp, Homo sapiens
ggctcaggccacataattggactctgtcacaaagggactttggaaaactactttttggtcatgaaattgttcatcgctgctggagaatgaacgtcattgcratttatcttgcttcattctgaaccttatcaagaggatctgactgagagcccactgcagttagagctgagcacttttgaaaagcttgtccatcactctagt

SEQ ID NO: 47449 - DNA, 201 bp, Homo sapiens
taactatttttagtgtgtggtcgagtagtgttaagtgtattcccattgttgtgaaattgatctgcagaactaagaccctgcacccgtaaaacaagaactcygcatttccccctttcccagacccttgtaactacttccactttctttcctttttttttttttttaatttattttatgaaagatgaggtcttgctctgtcag

SEQ ID NO: 47450 - DNA, 201 bp, Homo sapiens
tcatgggaggttgtgcccttgagcccccggtccccaagtgtgtgttgcctactcctgctgggaaattggagcagcctttggggggaaaaaaaagaaaaactctctgcagtttgttctccatgtcaggaggtggctggtgggttttgtgaatggcgccgtaatcttttcatactcatcttctctgtgagggcagggacttgt

SEQ ID NO: 47451 - DNA, 201 bp, Homo sapiens
agacagagtcagacactctgtcacccaggctggagtgcgatggggtggtcatagctcactgcagcctcaaactcctgagctcaagcgatcctcccacatcrgcctcctaagtagcatagcaccacgcctggctaatttttaaattttttgtagtgatggggttttgttgtctaggctagtctcaaactcctgggctcaagc

SEQ ID NO: 47452 - DNA, 201 bp, Homo sapiens
  misc_feature (1)...(201): n = A,T,C or G, or insertion/deletion polymorphism (see Tables 1-2)
agaagagtaccaggccatccagaaggccctgaggcagaggctgggcccagaatacataagtagccgcatggctggcggaggccagaaggtaggagaattcntgtgcctggaaagcaggcatccataccgcagactccgatggtcttgccagttccctctctgggtcctcagggattcggaagtctgctgttaactgttcct

SEQ ID NO: 47453 - DNA, 201 bp, Homo sapiens
cctctctgggtcctcagggattcggaagtctgctgttaactgttcctggaggtctcccagtgcccctgggaggggatgggttccagacttcattctcatcygaaggggcctgggcatggtcttgacactcgcataaccgccgtcttaagatttttacatcatctttttttttttttatttttaaagacagggtcttgctct

SEQ ID NO: 47454 - DNA, 201 bp, Homo sapiens
tttaactaaagcgaagagacaagatcttgaaccgtctgtggaggaggcaagatacaacagctgccgaccgaacatggccctgggacacccacagctgcagsaggtgacctccccttccagacccagccatgctgtgataccggcggaccaggactgcagctcccggtatgcggcctaagtcccctcctttcctctgcggcc

SEQ ID NO: 47455 - DNA, 201 bp, Homo sapiens
  misc_feature (1)...(201): n = A,T,C or G, or insertion/deletion polymorphism (see Tables 1-2)
tcccaacagaccattcgttctcgcgggctccatctagaagatttttgaaataaattcattgagaattttcttgaaaaaaaaattttttttaacagactggntctcactctgtcacttaggctggagtgcagtggcacgatcctagcttactgcagccttgagctcctgggctcaagtgatcctcccacctcagcctcccga

SEQ ID NO: 47456 - DNA, 201 bp, Homo sapiens
tgtatgtttctagtagccacagaataccttttaggcgacataaaaatcctcattttcgtgtggttttgttgagggggttctggctgatagcatatgtccakttcctctttggtcctaaccaaagggaagtgtacttttagggggaggggagagaaattccaaaaactttcagaaggtactgaagacatggaatttctgagg

SEQ ID NO: 47457 - DNA, 201 bp, Homo sapiens
  misc_feature (1)...(201): n = A,T,C or G, or insertion/deletion polymorphism (see Tables 1-2)
tccttgtagggacattgtgtgcacagaaaagagtttcttgctttgtccacccaaactccatctttgtctttagcagagagttgtgagtattcatctcatcngagcagggcaagggggacaaaacccaaatcagcaagcagtagtgtgtttctgtttgtgcaggatgggaaattgttgtattggagaaggcgtcaatctctg

SEQ ID NO: 47458 - DNA, 201 bp, Homo sapiens
cccaacagaccattcgttctcgcgggctccatctagaagatttttgaaataaattcattgagaattttcttgaaaaaaaaattttttttaacagactggtyctcactctgtcacttaggctggagtgcagtggcacgatcctagcttactgcagccttgagctcctgggctcaagtgatcctcccacctcagcctcccgag

SEQ ID NO: 47459 - DNA, 201 bp, Homo sapiens
ctgatgacgcacttttccttgacctctgtagagactcttgaagacaactctgaaaagtgggctgtgactcccgatgcaggggatggtgtggtcaagccctmgtctagagcagacccagcccagacctctgacacattagccttgaacaaccagatggtgacccagaacaggactccacacagcgtttgccaccagaaacca

SEQ ID NO: 47460 - DNA, 201 bp, Homo sapiens
gtttattttaaaattatggcagctacatttaagccattttgtcttccataggaaactgggaatctcataggaagagccaggacatgaagaaaaggaaatakgatccatcttaactgaggctcaggccacataattggactctgtcacaaagggactttggaaaactactttttggtcatgaaattgttcatcgctgctgga

SEQ ID NO: 47461 - DNA, 201 bp, Homo sapiens
aggctcaggccacataattggactctgtcacaaagggactttggaaaactactttttggtcatgaaattgttcatcgctgctggagaatgaacgtcattgygatttatcttgcttcattctgaaccttatcaagaggatctgactgagagcccactgcagttagagctgagcacttttgaaaagcttgtccatcactctag

SEQ ID NO: 47462 - DNA, 201 bp, Homo sapiens
attttaaaatacaataattttaccatcactgataagtgtttggaaactcaactttaggcaaagcaggtccttttgttataacattgatgaaaacaaaaatwtgttttgttaataagttgtttcacttcaagtcacagttatttaaggtgttaagtgagcacttaccgtaaatctgttgaatcttgttaaatattccagtgg

SEQ ID NO: 47463 - DNA, 201 bp, Homo sapiens
tcattcatggtacgagcagcagtttcattgctgtataattttcttttgcatgagtatgtggcaatttatttttctagtcttttcttagtagacattttggwttttgtagcttgtggctgtttcgattagagatgctgttagcattcttttgctgtacagttgcactcatttttgttgggaattattgggggagaagatagg

SEQ ID NO: 47464 - DNA, 201 bp, Homo sapiens
tagtagagacggggtttttccatgttggtcaggctggtctcgaattcctgacctcaggtgatctgccctcctcagcctcccgaagtgctgggattacaggygtgagccaccacgcccggccctgtctctactaaaaatgcaaaatttagccgggcatggtggcgcacacctgtaatctcagctactcaggagactgaagca

SEQ ID NO: 47465 - DNA, 201 bp, Homo sapiens
  misc_feature (1)...(201): n = A,T,C or G, or insertion/deletion polymorphism (see Tables 1-2)
aggccacttggtctaggagaatcatctgccttcctcctaacagtaattctcattcttgggcttagtctaaattaggatcattaatataatccagaaatcantagctgtcagtttattttaaaattatggcagctacatttaagccattttgtcttccataggaaactgggaatctcataggaagagccaggacatgaagaa

SEQ ID NO: 47466 - DNA, 201 bp, Homo sapiens
gactagttgtgaaaaattttgagtcacccactgtatgctttcccagctatgttcaaataaggtgacactctgccttcctgtttcagctctaaaactgttcrtaagtgttattttggctgtatacgtagtgccatgtttttttgtatttttgtgcttttggtgattttgctgtttatagtggcctccaagaatagaagtgct

SEQ ID NO: 47467 - DNA, 201 bp, Homo sapiens
ctcccgggtacaagcaattctccagcctcagccccccgagtagctgggactacaggcacgcgccactgcatctggctaagttttgtatttttagtagagayggggtttcaccatgttgaccaggctcgtcttgaactcctgacctcaggttatccacctgcctgggcctcccaaagtgctgggattacaagtgtgagccac

SEQ ID NO: 47468 - DNA, 201 bp, Homo sapiens
ttttaaaatacaataattttaccatcactgataagtgtttggaaactcaactttaggcaaagcaggtccttttgttataacattgatgaaaacaaaaatakgttttgttaataagttgtttcacttcaagtcacagttatttaaggtgttaagtgagcacttaccgtaaatctgttgaatcttgttaaatattccagtgga

SEQ ID NO: 47469 - DNA, 201 bp, Homo sapiens
  misc_feature (1)...(201): n = A,T,C or G, or insertion/deletion polymorphism (see Tables 1-2)
aaaggtttgcttcatggcacattaattcccatagacttctaggttgtacatgtgtgggtaccaggtgggtcccacagacccttacacctccaaggcaagcngcaagccacgggtgggaagtgataggtacccagtatgagcaggaggtaagggaccgtggggttgtgcctgtgggcagttggttataacccagacgtgttt

SEQ ID NO: 47470 - DNA, 201 bp, Homo sapiens
gatctcaaactcctgacctcaagtgatccacctgcctcagcctcccaaagtgttgggattacaggcatgagccaccatttcctaagtgagcacagctgttyacctcccagatagagaatcagacctttaccagcagcccagaagccccattttgccctcttccagtcactgccttgctttccttttttcaaaagtaactac

SEQ ID NO: 47471 - DNA, 201 bp, Homo sapiens
  misc_feature (1)...(201): n = A,T,C or G, or insertion/deletion polymorphism (see Tables 1-2)
atccatctaaaggaagggtggacggacccctcagcttctgtatctcactggaaaaaggtttgcttcatggcacattaattcccatagacttctaggttgtncatgtgtgggtaccaggtgggtcccacagacccttacacctccaaggcaagcggcaagccacgggtgggaagtgataggtacccagtatgagcaggaggt

SEQ ID NO: 47472 - DNA, 201 bp, Homo sapiens
gctaatttttatacttttagtagaaatggggtttcgccatgttggccagggtgatctcaaactcctgacctcaagtgatccacctgcctcagcctcccaamgtgttgggattacaggcatgagccaccatttcctaagtgagcacagctgtttacctcccagatagagaatcagacctttaccagcagcccagaagcccca

SEQ ID NO: 47473 - DNA, 201 bp, Homo sapiens
aaggatcagtgggtggtaggagaaggtgagcaggtagggaagtaggtagctggacggggacccaggctccagagttgtgtctcagccagcgttccctagartggtggaattcaaatactcttgctcatgtgctccctaaaagaatggaaaaactgttctcttgcacatgttcaagctgacacctaaaagttttcaccatat

SEQ ID NO: 47474 - DNA, 201 bp, Homo sapiens
gtgtgagccactgcacctggctgacattcttatcattatataatactctcgtctcctataacaattttttttttttttttgagacggagtcttgctctgcygcccaggctagagtgcagtggtgcgatcttggctcactgcatcctttgcctcctgggttcaagcagttctcctgcctcagcctcctgagtagctggaact

SEQ ID NO: 47475 - DNA, 201 bp, Homo sapiens
gcgttccctagagtggtggaattcaaatactcttgctcatgtgctccctaaaagaatggaaaaactgttctcttgcacatgttcaagctgacacctaaaasttttcaccatatataaaaattgttgcaaaggatgtattttttggcatatggtaaaatctgacattttaaaatacaataattttaccatcactgataagtg

SEQ ID NO: 47476 - DNA, 201 bp, Homo sapiens
atgtgtacttgagaagaatgtattttctgctattggtgggtggaatgttatgtatatgactgttaggtccagttggcctatagtattgttcaaatactctrtcgccttattcatcttttgtttggttgttttatctattattgaaagttgagtagtgaagtctcctactattattgtgttgcttttatttcaccttacaat

SEQ ID NO: 47477 - DNA, 201 bp, Homo sapiens
ccaaagtgctgagattacaggcgtgagcccccgcgcccggcctttgttaggcatttttgcatctatgtttatgagagatattagtcaagttttctttttctttttttttttttgagatagtctcactctgtcgcccaggctggagtgcagtagtgtgatctcagctcactgcaacctctgcctcccgggttcatgccattc

SEQ ID NO: 47478 - DNA, 201 bp, Homo sapiens
tttagacatattctgaaggggattgctgggtcatggtaatcctatttttaatttttcgaggagctgccacactgattttcatacagttgccccattttacyattccaccaacagggcacatgagttcagatttttctaaatcctaaccagcacttgttattttctgagtttttggttttttttttttttttttttttttaa

SEQ ID NO: 47479 - DNA, 201 bp, Homo sapiens
tgtgaaattgatctgcagaactaagaccctgcacccgtaaaacaagaactccgcatttccccctttcccagacccttgtaactacttccactttctttcctttttttttttttttaatttattttatgaaagatgaggtcttgctctgtcagccaggctggaatgcaggagtgccatcataattcactgcatccttgcact

SEQ ID NO: 47480 - DNA, 201 bp, Homo sapiens
tcctcctgcctcggcctcccaaagcgctgggattgcagcgtgggccactgtacctggagccagctaattaactttttttgggggcttttttttttaagagrtgagttcttgctatgttgctgaggctggtcttgatctttttttcttttttaaaaaattaggttaggcgctgtggctcctgcctataatcctagcactttg

SEQ ID NO: 47481 - DNA, 201 bp, Homo sapiens
gttagtattttttcaatgtttctgtttcaggcttcccttgctgggagtaagtggtagaatcctgtactctctcttctccgtgcactcagtcatgtgtgccrgaggccttcccactcctactgcgagtgcacagacagcaccctcctctccgtgctcctcagcagtcctccgctacgcacaggtagcatagttaacttagtt

SEQ ID NO: 47482 - DNA, 201 bp, Homo sapiens
ccttacaatcctctcaaagtttgcttcatatatttaggacctctggtgtttggtgcataaatatttataattgttatatcttcttggtgaattgacattcttttttttttttttgagacggagtctcactctgtcgcccaggctggagtgcagtggcggtgcgatctcagctcactgcaggctctgcctcctgggttcaca

SEQ ID NO: 47483 - DNA, 201 bp, Homo sapiens
ggggttgcagtgccagtacacagcagaagagtaccaggccatccagaaggccctgaggcagaggctgggcccagaatacataagtagccgcatggctggcrgaggccagaaggtaggagaattcgtgtgcctggaaagcaggcatccataccgcagactccgatggtcttgccagttccctctctgggtcctcagggattc

SEQ ID NO: 47484 - DNA, 201 bp, Homo sapiens
gggtgagttcctcctcccaacagaccattcgttctcgcgggctccatctagaagatttttgaaataaattcattgagaattttcttgaaaaaaaaattttktttaacagactggttctcactctgtcacttaggctggagtgcagtggcacgatcctagcttactgcagccttgagctcctgggctcaagtgatcctccca

SEQ ID NO: 47485 - DNA, 201 bp, Homo sapiens
ttgttttttttttttttttttttttgagacggggtctggctgtgttgccctgactggagttcagtggtgcaaacacagctctctccacaacctcttgggcycaagtgatactcccacctctgccttacaaaatacagggattactggtgtgagccactgtgtctggccagaaaaggcatttttgagaaagcaaatcgtata

SEQ ID NO: 47486 - DNA, 201 bp, Homo sapiens
cttcagagcagatttcgattttttttggaagaggtaacacatccacatggttcaaaaatccaagcagcgtggaaggtaattctcacccctgccctggttcytgtctgccgttttcccactttcgttagtattttttcaatgtttctgtttcaggcttcccttgctgggagtaagtggtagaatcctgtactctctcttctc

SEQ ID NO: 47487 - DNA, 201 bp, Homo sapiens
  misc_feature (1)...(201): n = A,T,C or G, or insertion/deletion polymorphism (see Tables 1-2)
ctgggaaattggagcagcctttggggggaaaaaaaagaaaaactctctgcagtttgttctccatgtcaggaggtggctggtgggttttgtgaatggcgccntaatcttttcatactcatcttctctgtgagggcagggacttgtgtcttgtcctcactgcagtattctcagaaactaacacagtgcaggaacatgctagat

SEQ ID NO: 47488 - DNA, 201 bp, Homo sapiens
tgcagtggcggtgcgatctcagctcactgcaggctctgcctcctgggttcacaccattctcctgcctcagcctcctgagtagctgggactacaggcgcccrccacctacgcccggctaattttttgtatttttagtagagacggggtttcaccatgttagccaggatggtctcgatatcctgacctcgtgatctgcccacc

SEQ ID NO: 47489 - DNA, 201 bp, Homo sapiens
ttaagcctcttttaacataaaagagttcaccagccattctattttgttttgctttttgagacactgatgctttggagagtccaggccagttgctttgtagwtttcaacttgtttgattgtttcctgatgattaggttggtagaaatactacctcaatgatgggaccttcttagtgcgtccatcaggaagcacatgatgtga

SEQ ID NO: 47490 - DNA, 201 bp, Homo sapiens
tctgcccccaggatggttcatatcatgaagatgttggttatggtgttagtgagggcctcaagtccaaggctttatctttggagaaggcaaggaaggaggcrgtgacagacgggctgaagcgagccctcaggtgagcgcggggctgggagtctaacctgcgtcatttcagctcttgcttcagagcagatttcgatttttttt

SEQ ID NO: 47491 - DNA, 201 bp, Homo sapiens
aaactctctgcagtttgttctccatgtcaggaggtggctggtgggttttgtgaatggcgccgtaatcttttcatactcatcttctctgtgagggcagggayttgtgtcttgtcctcactgcagtattctcagaaactaacacagtgcaggaacatgctagatgcttaccagacatcaatggggaatgcatgttagggtcca

SEQ ID NO: 47492 - DNA, 201 bp, Homo sapiens
gtgttatcattctctacctgctttcaagattttctctttatttttgttttttagcagtttgtctgtggtgtatctaggtgtcattttatttgtatttatcyggagatttattcttgagatttgcagagcttcttaaatctgtaaatttatgtctgtcggccaatttgggaaatttggagctattagttttaaaaatatttc

SEQ ID NO: 47493 - DNA, 201 bp, Homo sapiens
tcacccatttctagtttaggtgaatggtgtgagatataattaaatattaatttcttttccatatagatatccagtcattccagcaccatttgttgaaaatrctattgtattgcgttttggaaattaagatgactgtacaaatggtaattgatgtctgcactcccttttctgttccattgttcaatccttgtgttagtacca

SEQ ID NO: 47494 - DNA, 201 bp, Homo sapiens
tcaggctgtgaagataatctttcatgttttcttctgtaagttttttttttttttgagacagagtcttgctctgtcgtccaggctggagtgcggtgatggcratctccgctcactgcaacctctgcctcccaggttcaagcgattctcctgccccagcctcccgagtagctgggattacagacatgcgccaccatgcccaac

SEQ ID NO: 47495 - DNA, 201 bp, Homo sapiens
tgcagtgagccgagattgtgccactgcactccagcctgggcgactgaacaagacttcgtctcaaaaaaccagtagggctccaggcctgggattgggcctcygctgctctactccctggacgtgtggctccgtccttggagtcggcctttggttttcatgaagagtagtgtgcattaacagctgagtggttttatcagcctg

SEQ ID NO: 47496 - DNA, 201 bp, Homo sapiens
tctaagatctcttccccttgtccatagcctagatcgagctccctgtgtgcaccgcgcgctgcccgaggcgcgtaagtgggggaggagagcggcttcccccsgggtggttctagccgtgggtgtggagcgtgggaaggctcagcttccgggtcgagaacctggggctgcggtggacctgatcctgaggtctcagcgtagaga

SEQ ID NO: 47497 - DNA, 201 bp, Homo sapiens
tccagcggtaggtagtccttactcagagagtggaaacagagaaagggcttgtctcagacccatcgagcttttgcccagtttttccctacaaattgtgaagmagattcacagaggacttgcttcatggttggttcattcatatgcccctcagcaccgacaggctgaaattaacataaaaaccaaaacagaaccacttcctgt

SEQ ID NO: 47498 - DNA, 201 bp, Homo sapiens
tttgtgtgctggtcttctcagggaggcagaaaccgtcagagattgctgttgtgtaatgtacaccaaaacgtgttatcttgtagtataaacggtgtagttgsagatgagtgtatgaaaaatgtaactgagctagctgtgggagagactagttgtgaaaaattttgagtcacccactgtatgctttcccagctatgttcaaat

SEQ ID NO: 47499 - DNA, 201 bp, Homo sapiens
ggttgcagtgaaccaagatcgtgccactgcactccagcctgggcaacagagtgagaccctgtctcaaaacaaaaacaaaacaaaaaaaaaacaagccttgkgtttctgagatatcttcgaatacaaggcaaaattgggattgagaataacgggaacttttggcagattatttatcaactttagtttatttcagagtccaga

SEQ ID NO: 47500 - DNA, 201 bp, Homo sapiens
ggaagttgggaagggaggatcgtcttgacaccttgaccacaggcacatgtccaggcagcccaggtctaggaagcagcactcgcgatggattctcacccagccttctgcccgtgcccctgtagcaaggccgccaggtgggagagtccggctttgaaccctgctgcttgaggaacaggggagttgtggcacgcctgccgctct

SEQ ID NO: 47501 - DNA, 201 bp, Homo sapiens
cttttttttttaagaggtgagttcttgctatgttgctgaggctggtcttgatctttttttcttttttaaaaaattaggttaggcgctgtggctcctgcctrtaatcctagcactttgggaggccgaggtggttagatcacttgagcctaggagtttgagaccaccctggccaacatggtgaaaccctgtctctactaaaaa

SEQ ID NO: 47502 - DNA, 201 bp, Homo sapiens
gggcccaagggatcctcctggatcctcctgcctcagcctctcaggtggctgggactacaggtatgtgccagtgcacctagctaatttattttttaaacaaktattactattttttttgtagagacagaatttctcagggctggtcatgaactgctgggctcatgtgatcctcctgcctcggcctcccaaagcgctgggatt

SEQ ID NO: 47503 - DNA, 201 bp, Homo sapiens
agctaatttattttttaaacaattattactattttttttgtagagacagaatttctcagggctggtcatgaactgctgggctcatgtgatcctcctgcctyggcctcccaaagcgctgggattgcagcgtgggccactgtacctggagccagctaattaactttttttgggggcttttttttttaagaggtgagttcttgc

SEQ ID NO: 47504 - DNA, 201 bp, Homo sapiens
ggatgatgacaaagttctggaaagggatagtggtgacagttatacaacataatgtacttactgccactgaacttatacactgaaaaatggttaaaatgatragttttattatgtatttttatcacaattttatttttttaaggaaaagttattttgtcatcttatttcctggccttatgacagagctgcacttaagtgtgt

SEQ ID NO: 47505 - DNA, 201 bp, Homo sapiens
gtggtgttgatggatatgagacagaaggcattcgaggactccgggcccttggtgttagggacctttcttataggctggtctttcttgcctgctgtgttgcrccaaccaacccaagggtcagtcgttttgggggtttttgtttgtttttgaaacagtctctctctgtcacccaggctggagtgcaatggcaaagtcatggct

SEQ ID NO: 47506 - DNA, 201 bp, Homo sapiens
gtcttgctctgtcacacccaggccgaaatgcagtggcgcgatcttggctcactgcaacctctgcctcccgggttcaagcgattcttctgcgtcagcctccygaatagctgggattacaggcgcccaccatcacgcccggctaattatttacattttttaatagagacggggtgtcaccatgttggtcaggctggtctcgaa

SEQ ID NO: 47507 - DNA, 201 bp, Homo sapiens
aaacaaattggttttgccacaaatggtgctattctgaaagtattcaaggcttaagtgaagtctttggatttatagctttcatttatttgagcaattttgaygttcagcacctttaatatttaagttgtgaaacaacctatcattctgtttcaggagcacgtgcagaaactaattcccgtgtcagtggtgttgatggatatg

SEQ ID NO: 47508 - DNA, 201 bp, Homo sapiens
actatttgactaaaaggagttttagagtagataatttttaggataaatgttggtacatgtgaaaagtctgctaatgggtcagatagtttagaatacgtccrtatttgtggtatttaatttagattatatggcatctgaaaggtattgcttctcattcttggttggttgtttgtctgtattacaggttcgtattcaagagac

SEQ ID NO: 47509 - DNA, 201 bp, Homo sapiens
gaagctgtggaatcagctcaagctggtgacaagtgtgactttacagggacactgattgttgtgcctgacgtctccaagcttagcacaccaggtcagtaatytgtggctcaaatttaacaaattctcagttacctaaactgcacagtatctagcttcccacatcttcattgtcttctttttggctaccaatcagaagctgag

SEQ ID NO: 47510 - DNA, 201 bp, Homo sapiens
ggtgttagggacctttcttataggctggtctttcttgcctgctgtgttgcgccaaccaacccaagggtcagtcgttttgggggtttttgtttgtttttgaracagtctctctctgtcacccaggctggagtgcaatggcaaagtcatggctcactgtagcctccactttctgggctcaagtgatcctaccatctcaacctc

SEQ ID NO: 47511 - DNA, 201 bp, Homo sapiens
agttcagtattggaaaaagggagtgaacataatattctcttattttatttgcatctttatgtcagtgattaacattctgctatcgcttatctcttgagcattcaggtagctttttttctatttaactcactggacaaatgacatacccttaagtgtctttgttaactgagggcttactagtttggggagttgttttttttt

SEQ ID NO: 47512 - DNA, 201 bp, Homo sapiens
ataggtatgggcatattaatcttctttactttgaataggggttgaaatccgggaagccagctcttcttggactgtaagtgttcacttgtgtagcagaaggkcagctttcacagttatttcccactgagaagaggcgctttgatactgccagtggtcgttttagtactgctctgaacttcatgtaggcctttgtagagccga

SEQ ID NO: 47513 - DNA, 201 bp, Homo sapiens
aaaggccattgcagactagaaatggagtaaaatcctcatgtagttattggtaaagtgtggcgtctggacactagtacgcttcctacccttaactgctttamcatgctattcaaagttttatcaccctatagttaactacaaagcagaaggaaaaatgatgaattcaagatgttgaacctaaacttctacttgatagttaag

SEQ ID NO: 47514 - DNA, 201 bp, Homo sapiens
aactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctca

SEQ ID NO: 47515 - DNA, 201 bp, Homo sapiens
ggccgtgcaggtcggaagagggggcggggcggaagcggcggcggcgcgcgcaaagctgcagcgtctggaaaaaagcgacttgtggcggtcgagcgtggcgyaggcgaatcctcggcactaagcaaatatggacctcgcggcggcagcggagccgggcgccggcagccagcacctggaggtccgcgacgaggtggccgagaa

SEQ ID NO: 47516 - DNA, 201 bp, Homo sapiens
ctgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcagg

SEQ ID NO: 47517 - DNA, 201 bp, Homo sapiens
agtgaaaccccatctctactaaaaatacaaaaaaaattagccgggtgtggtggcgagcgcctgtagtcccagctactcgagaggctgaagcaggagaatgrcatgaacccagtaggcagagcttggagtgagccaagatcaagccactgcactccagcctgggtgacagagcaagactctgtctaaataaataaattaatt

SEQ ID NO: 47518 - DNA, 201 bp, Homo sapiens; identical to SEQ ID NO: 29786

SEQ ID NO: 47519 - DNA, 201 bp, Homo sapiens
aagtaggtggatcacctgaggtcaggagttcgagaccagcctggccaacatggtgaaaccccatctctactaaaaatacaaaaattagccgggcatagtgrcgcacacctgtaatcccagcaactcgggaggctgaggcaggagaatcgcttgaacccatgtggcaaaggttgctgtgagctgagatcacaccactgtact

SEQ ID NO: 47520 - DNA, 201 bp, Homo sapiens
cctgggctcaagccagcctcccacctcagcctcctgagcagctggaactacaggtgcaggcccccatgcccagctaacttttgtattttttgtagagaccragttttgccgtgttgcctggactggtcttgaactcctgagctcaagctatccaccagccttggcctctcaaagtgctaggattacaggcatgagccactg

SEQ ID NO: 47521 - DNA, 201 bp, Homo sapiens
atgagtcaagataaaaatctataccacaatctttgtaccagcctgttccctactatacatggtaagaattccatccatttgtaccataaacttgaaatcamaataatgattataaacagccacaggtgatttctgaaagcacataaatcagactgtgaaagtttttagtgggtctgaaagaggtcatttacaaaaggacag

SEQ ID NO: 47522 - DNA, 201 bp, Homo sapiens
  misc_feature (1)...(201): n = A,T,C or G, or insertion/deletion polymorphism (see Tables 1-2)
acatacccttaagtgtctttgttaactgagggcttactagtttggggagttgtttttttttaaacctttacagtcaataaattgtgaggttgacttcccangctatgttgtgtttgtaatgaagtttcttctcctttatgctcttttgactgcttctatactaatgattcttcctttgttctctaccattagtttgggggg

SEQ ID NO: 47523 - DNA, 201 bp, Homo sapiens
tcccccgcagtttagaagtaattttaagggctgaagctgtggaatcagctcaagctggtgacaagtgtgactttacagggacactgattgttgtgcctgaygtctccaagcttagcacaccaggtcagtaatctgtggctcaaatttaacaaattctcagttacctaaactgcacagtatctagcttcccacatcttcatt

SEQ ID NO: 47524 - DNA, 201 bp, Homo sapiens
ttagataatgttcaactcaatttttatgtaagttaagcatcatcaaaatgactacaaagttaagcccaaaactgttcatgtaaattataattgttagtatytacatttgttttaactttcagtaacttggaagttccttaagactgacaagatgtatttgtcaaagaataaatggtaactaggtggtggtggttgtcatta

SEQ ID NO: 47525 - DNA, 201 bp, Homo sapiens
aaacagcccacagaaaattcacagtattgagcataatattgacaagatgattgttcagctagtcatcttggacagaggaatggccaacagtgtgggtgctvtatgattatttatgtgctatatgataatcaggtatggtatgacattttatatttagtgttccggtgggataggagagaactgaaagagggtcctaaacct

SEQ ID NO: 47526 - DNA, 201 bp, Homo sapiens
  misc_feature (1)...(201): n = A,T,C or G, or insertion/deletion polymorphism (see Tables 1-2)
cattagcagatctgctacaacagagttccaggagccttccaagtctgcaagtgcagagttttgtaaggatcttctgtcacattttgatgtctttgtgtgtntgctgtgtatgaaattactcaaattcatataaaatttcttaaactcatactaatagctccaattgtggttttttggtagaaatactatggttagacatta

SEQ ID NO: 47527 - DNA, 201 bp, Homo sapiens
aaagaagagttagttgttgggtttttttgttagttagcagttaaacctcacaatcatggtggaaggcaaggaggagcaagtcactgatgtcttacgtggayggcatcaggcaaagagagcttgtgcagaggaactcctctttttaaaaccatcagatctcgtgagacttactatcagagaacagcaggggaaagacttgtc

SEQ ID NO: 47528 - DNA, 201 bp, Homo sapiens
gggctttagaagcaaaaataccagcagctttatttagtgtgcctgtttcaattttccctaagtcttgggctgtgaaacacctcatttccatgtattcttayttctgttctgcttcttaaatccctgactaatttgttagtttgcaaattccctacagaaatggaatcattgggtttgagactgaatttcttgatttaacat

SEQ ID NO: 47529 - DNA, 201 bp, Homo sapiens
atgtttgaaagaacagaaataaatttgtatgatatcctgcttgggctttagaagcaaaaataccagcagctttatttagtgtgcctgtttcaattttccckaagtcttgggctgtgaaacacctcatttccatgtattcttacttctgttctgcttcttaaatccctgactaatttgttagtttgcaaattccctacagaa

SEQ ID NO: 47530 - DNA, 201 bp, Homo sapiens
agataaactcactttagcaaagtaaatttgtggagtatcagcatacctgccagcctgaacatttcttcacaagcttattgtcaggcaaagctttgtaggtycttctttttaacattctgggcctattttaataattttgggacctgataacatatgaagcagcacatacaaatgtttttacaaatgcaaaattactattcc

SEQ ID NO: 47531 - DNA, 201 bp, Homo sapiens
tattttggcaatcttttaccagcacatattagatcaactttcgttttttattaatttcccatattcaattgtgtataccacagcttgattctttagactcytgttgagtgacatttggttcattttcagtgttttgtattacaaacaaaattgtagtaagcatccttgaacgcaacatccttttatatttggctataagag

SEQ ID NO: 47532 - DNA, 201 bp, Homo sapiens
gtacacaattgtaaattgaaaagacaactctttccctgcaactcccagcaacagtagatacttagaggtatctaatggataaaaaggaattttaggaggargaaaataaggcatctattgagtttgtgccccttttaggaatattttgtacataagcataatactgacaatttcattcctgctggtttaacttcataattt

SEQ ID NO: 47533 - DNA, 201 bp, Homo sapiens
gtttaggtggtcatgtagttcttttattaatttagcatattgattgattttcagatgttaaaccaatcttgcatttctggaataagccccatatctagttytgttttgttttatttttaattgcaagaccttctgatagatgattgttgctgtttattactattaaagacttcttttaaaattgatgttttagctgggcgc

SEQ ID NO: 47534 - DNA, 201 bp, Homo sapiens
cggatgcactgctgtgatgaggtatcagagtcactttgatatgatgagagcagagataaacagatttgttgcatgtttttaatctttggtatgggacatamtagaattcactgcaaatacatttttatgtaactgttgaatgctcatacgaccatggaattcttccctttaaagagcttggtaagcatttgagtgtagttg

SEQ ID NO: 47535 - DNA, 201 bp, Homo sapiens
aaggctggatgtggtggcccacacctgtaatcccagcacttgggagaccaagacaggaggatcagttgagtccggtagttcgagaccagcctgggcagcayagcaagaccctgtctctaaaacaaataataataataatttttaaaagtgaaaaaaatcagtattaaatgtaagtagtgtatttgtaaatgcttgacaagg

SEQ ID NO: 47536 - DNA, 201 bp, Homo sapiens; identical to SEQ ID NO: 29801

SEQ ID NO: 47537 - DNA, 201 bp, Homo sapiens
tggccgagaagtgccagaaactgttcctggacttcttggaggagtaagtcggcgagcgccccgggcctcgcccgcctccggagcctgcggcgtctgggccrggcggtgccgtgtgggcggcgggtgttccggaacctgggggtcgcgcgtccgggaagcgcctccccgcccgccccccaactttaggctccgagcccggcg

SEQ ID NO: 47538 - DNA, 201 bp, Homo sapiens
atgataggattattatgtaacacatgcttttttttttagaaattgcgggtaagcaaaaaagtatttgcatataaaacaaaaacaggatcattctgtttttktttttttttttttctgagacagagtcttgctctgtcacccaggccagagtgcagtggcacgatcttggctcactgcaccctccacctcccgggttcaaac

SEQ ID NO: 47539 - DNA, 201 bp, Homo sapiens
tcatgtaggcctttgtagagccgaacgtttttttgttgttgtgttttgtttgtttgtttgtttgtttgttttttgagacggagtcttgctctgtcacaccyaggccgaaatgcagtggcgcgatcttggctcactgcaacctctgcctcccgggttcaagcgattcttctgcgtcagcctcctgaatagctgggattacag

SEQ ID NO: 47540 - DNA, 201 bp, Homo sapiens
ctcttcagtataaagaagtcagaatacccctaccctatcagtaaaggcctataagttaccattaaaaagatgtccttaaaaacagcattctcagctgggcrcggtggctcacacctttgtcccagtactttgggaagccgaggtgggtggatcacctgaggtcaggagttcgagaccagcctggccaacatggcgaaaacc

SEQ ID NO: 47541 - DNA, 201 bp, Homo sapiens
ttaggctgaggagtttgagcctatcttaataagcagtgggaatatagtgggaaggtagtttgtgtgtgtgggtgtgtgtttgttttgttttgttttttgtytttttttgagacagtctctctctgtcacccaggctggagtgcagtggcgcgatctcggctcactgcaagctccgcctcctgggttcacgccattctcctg

SEQ ID NO: 47542 - DNA, 201 bp, Homo sapiens
attaacctggtagcttataagatgcacatattttaccaacagctttgggtaggagatgtcttatcttataaagtatgaatctagattgggtcttagtttgsgggggggaacacaactgtataaaggacactcttgacaagacatttgaagatggactagataatagaagatatgtaattttatgaaattaaatattgttta

SEQ ID NO: 47543 - DNA, 201 bp, Homo sapiens
taataacattttaccctgtttgctttattgcttactgtctgtatatatctgcacacttttttcctgaaccatttgagagcaagttgcatattttggggtctttttttttttccagtattctgggatgaatatcttcaaaatttagtggctaagagcacagtctctgaagctagactattcaaatcctggctccactactta

SEQ ID NO: 47544 - DNA, 201 bp, Homo sapiens
acaccatgcgtggctaatttttatatttttagtacagacagggtctcaccatgttggtcaggctggtcttgaactcctggcctccagtgatgcacacccayctcagcctcccaaaatgttgggactataggtgtgagccactgtacctggccccaaccacactcttaagatttttatacaattttttgttttgttgattgg

SEQ ID NO: 47545 - DNA, 201 bp, Homo sapiens
aaagttattaccgtttatgatactaacagttcctgagacttagctatgatcagtatgttcatgaggtggagcagttcctgtgttgcagcttttaacaacasatggcattcattaaatcacaaagtatgttaaaggtcacaaaagcaaaataactgtctgaggctaaggcccacgtgggacagtctaatacccatgagtact

SEQ ID NO: 47546 - DNA, 201 bp, Homo sapiens
tgttccattgcttcagcttgttaagcagcttttagaaatggtcatttgcttaaatactaagccttttttcaggttcataaaattagtaacatggaattcayaagcctccttaatattagtttcttttgaaagacattacaatagtaatttattgtcactggcttctcaaagtttcaaccctctcaggttccctaaatgttt

SEQ ID NO: 47547 - DNA, 201 bp, Homo sapiens
gctaggagctcttctcatttgtggacagttttgactaacctgtaattatatcgtgggcttaaaatctgtcatcaagattttaagccagatggcatgttctmcctttttttttattagctcagagtgaaaaatttttcagatgaattttcatagattcttctcctaactctatgaaatggtggtatatgaaaaagttcagtg

SEQ ID NO: 47548 - DNA, 201 bp, Homo sapiens
  misc_feature (1)...(201): n = A,T,C or G, or insertion/deletion polymorphism (see Tables 1-2)
agctcccatcatgtcccgattcgatctcttctttatccttgtggatgaatgtaatgaggtaaccccatgagcttccttttttatttccagttggagtaatngagtgagacaaggctggaagatacactgctcaacagctggtgcatgtatgtgcaccagcctttgatttccctcagggtggcacaggatcggacaaagggt

SEQ ID NO: 47549 - DNA, 201 bp, Homo sapiens
tcatcttggacagaggaatggccaacagtgtgggtgctctatgattatttatgtgctatatgataatcaggtatggtatgacattttatatttagtgttcmggtgggataggagagaactgaaagagggtcctaaacctagagtagataatagaagtgtcctacacagttaagttctaaggtttagttgtaaccagatgaa

SEQ ID NO: 47550 - DNA, 201 bp, Homo sapiens
gtaagttaccatttaatacctttcattcaggaaaaatgtacttagaccctacaatgtactagtaggcctctgcgctggcaatacagataagataatgtagyccctggcctcaaaggaactctcctccttaggttgcatttgtataatgtttgatttttagattgttctttgagccctgcattccacgaggataggtcagtg

SEQ ID NO: 47551 - DNA, 201 bp, Homo sapiens
attttgtacataagcataatactgacaatttcattcctgctggtttaacttcataattttattttggcaatcttttaccagcacatattagatcaactttsgttttttattaatttcccatattcaattgtgtataccacagcttgattctttagactcctgttgagtgacatttggttcattttcagtgttttgtattac

SEQ ID NO: 47552 - DNA, 201 bp, Homo sapiens
tggcaagcattctcagaggtggtgaagcataagaagatgaagaaaagaccttcatactttgaaatcttaatagctttaagaaacatatttcttataatctkttttattaggtttctctccttatggataaaataaggcatgctttaatacaagtgatatgacttgttatttcaggcttatgctagaacattgcggacctta

SEQ ID NO: 47553 - DNA, 201 bp, Homo sapiens
tgtaaccagatgaaattccttaatctcggctgttggtaggtatgtaaagggaaggaggccttggtaaacctctaaggtatcagctgacttttttgtttttyagagtttacccttacctgtgtcgggccttgaaaacattcgtcaaagaccgtaaagagatccctcttgccaaggatttttatgttgcattccaagacctgc

SEQ ID NO: 47554 - DNA, 201 bp, Homo sapiens
cattcttggaatcatctagtcagtcacttcaccacctgtttttatttgaaatttttaactctttcagaagctgaattccaacgccaccttttatatgtatracttgtagttgtttttttaggcagaattagtttctattcccctagcacatttcttgttcttctcattaacaggaacatctttcttgtctgtcttcattgc

SEQ ID NO: 47555 - DNA, 201 bp, Homo sapiens
cctccaggatgaagggtcagcagtttggaatggcttttgaagttcttttttagtaaaatatacataacaaagttgaccattttagccatttttaagtgtasagtccagtggcactaagtgcattcacctcgttgtgcagccgtcaccactctcccatctccaaacttttttttttttgaggcgtaatttagcccttgttgc

SEQ ID NO: 47556 - DNA, 201 bp, Homo sapiens
aaagcagggaagagaaggtggtgagccatgtgctttctcccccttctatccagaaatgacacatactcacatttcattcgccagagaaattaacatggccmctcctaagttcaaatggatagagaaatgccttcctaccaggtgcccagaattagaagagcaaacatttgtgaacagttctgagtaccacaaataccgtta

SEQ ID NO: 47557 - DNA, 201 bp, Homo sapiens
ttgcctctggtaacagtgtcatgtggtatgtgacagtcttagtggattccatagcattttctatgtataaaatctgtatataatgatagtcggagtatccmatctggctgcctttttttcttgcctaattgtccttgattagagccatcagtataatgttgaatagaagtggcaagagcagacatccatgtcttattcctg

SEQ ID NO: 47558 - DNA, 201 bp, Homo sapiens
tgtatttttatcacaattttatttttttaaggaaaagttattttgtcatcttatttcctggccttatgacagagctgcacttaagtgtgtttccatatgckagactagtctcctggcctttttgtggttgtagtctcctggccttgttggtgtgtgtgtatgtgttttagagagacggggttttgctatgttgtctaggct

SEQ ID NO: 47559 - DNA, 201 bp, Homo sapiens
tttttggcagaggagatcatgtgggaatgtatgcttgttttaaaattagtgttaaggctggatgtggtggcccacacctgtaatcccagcacttgggagaycaagacaggaggatcagttgagtccggtagttcgagaccagcctgggcagcatagcaagaccctgtctctaaaacaaataataataataatttttaaaag

SEQ ID NO: 47560 - DNA, 201 bp, Homo sapiens
ctacttgggaggctgaggcaggagaatggcgtgaacccaggaggcggagcttgcagtgagccgagattgcgccactgcactccatcctgggcaacagagcragactccgtctcaaaaaaaataaaaataaaataggatgtactttccaaagggaatgctgctatgagatattttatgttaactttgtcagtgtgaacacaa

SEQ ID NO: 47561 - DNA, 201 bp, Homo sapiens
gacctcgcggcggcagcggagccgggcgccggcagccagcacctggaggtccgcgacgaggtggccgagaagtgccagaaactgttcctggacttcttggwggagtaagtcggcgagcgccccgggcctcgcccgcctccggagcctgcggcgtctgggccgggcggtgccgtgtgggcggcgggtgttccggaacctggg

SEQ ID NO: 47562 - DNA, 201 bp, Homo sapiens
ttttagagagacggggttttgctatgttgtctaggctgaagcactccctcctgggctaaagcaaccctacctccagcctccccagtagctgggattacagrtgtaggtcaccacattggctcttgtttctctttttatttaccaaaatggagtgtttatgattggttacttgttctgtctatacctttggcagtttcacat

SEQ ID NO: 47563 - DNA, 201 bp, Homo sapiens
acgtcaccagatgtactttcggacggcttgacatttatctaatctgtacattatctcgttgtatatgtggcagagatttacccaaggactgacagtacgarttgctaggataatttgaatgtgtttttttgttgcagaagaggacgagtcagcattaaagaggagcgagcttgttaactggtacttgaaggaaatcgaatc

SEQ ID NO: 47564 - DNA, 201 bp, Homo sapiens
cacttgatccctgaagactggggctacagtgagctgtgatcatgccactgcactccagcctgggtgacagagtcaaactctgtctcaaaaaaaaaaaaaaaagaatataggccaggcacagtggctcatgcctgtaatcccagaactttgggaggccaagacaggcagatcacttgaggtcaggagtttgagaccagtctg

SEQ ID NO: 47565 - DNA, 201 bp, Homo sapiens
tcactgcaggcgccgccgacgtgtcttagcggttagtcatccctcttaccgccttcctccacttcctggactgcgcgaccggaggcctagcgggcgcgcgsccgcaccatcgactcgccaacgagagaaggtcctggggcacggacaccgacgggttgcgactgtgacgtgaggtgttctcgcgcgcgctagcgcgcgtct

SEQ ID NO: 47566 - DNA, 201 bp, Homo sapiens
atataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattctaccttgcatcttgcttttttgcttacatagt

SEQ ID NO: 47567 - DNA, 201 bp, Homo sapiens
ctctcagtccagaaatgcagagctttgtgagataccacccacttctgatacaaagtcagatactgcaacaggtaacttttaatgtacctttttgagtgcartagaagctccttcactacattttaatatttaaatattaatattttaaaaatatattgtatgtatttttcttcacatttatttaacttaaaatttaagagt

SEQ ID NO: 47568 - DNA, 201 bp, Homo sapiens
cagtatataaggctgtaaaatgagaattctgccccctcacctcttaccccagtactattctccagaggtaatctattaacaatttcttatgtaattttcaraaaatttgtatgcgtatataagcaaatatgtaatctttattttttaaataaatgggatcatattatatattctaccttgcatcttgcttttttgcttaca

SEQ ID NO: 47569 - DNA, 201 bp, Homo sapiens
atgtgataagtaatagaaattcttttttctctgccctcagtatggagaagccctagtcatgtgtttatgtattccataggtaatgacatataagtattgtrattgggctgctttgtcctttatcttatttcataactgttaggcaggaagaccagttacctactaagtacgttactgtagtgaggacagagggaagctcaa

SEQ ID NO: 47570 - DNA, 201 bp, Homo sapiens
aggcattataacaaatcttcatgccagtcctatgtgataagtaatagaaattcttttttctctgccctcagtatggagaagccctagtcatgtgtttatgkattccataggtaatgacatataagtattgtgattgggctgctttgtcctttatcttatttcataactgttaggcaggaagaccagttacctactaagtac

SEQ ID NO: 47571 - DNA, 201 bp, Homo sapiens
attagtttttgagatggggtttcattacgttgcattacactaccatgctcagctgattttatattattatttttttttcctgaggcggagtctcactctcrcccaggctggagtacggtgacatgatctcggctcactgcaacttccgcctcccaggttcaagcgattctcctgtctcagcctcccgagtagctgggttta

SEQ ID NO: 47572 - DNA, 201 bp, Homo sapiens
cagtgttgcagcactatgaagataattcctgttttctctagtagagtcatagtatatacattttttgtgttcttttcgtaaattactatgaataaattagmccatgctttttccctctgcaatgatttttttttacactaagaataaagggacttgagctaaaatgtttggcttgaggttgaacaaagttttagttcattt

SEQ ID NO: 47573 - DNA, 201 bp, Homo sapiens
gggccttcaagcgccctgtaaggactttggcttttactttgaggaaaatggggagccattgtgtgatctaagcagagggttgatgtgatctttttttttttagagaaagttgctgtgttaagaatagacttagcaggaagaccaatttggaggcttttactaggcttccaggtgagatgtgatagcttggatcagggtagt

SEQ ID NO: 47574 - DNA, 201 bp, Homo sapiens
cactgactacattattatcttaacagaccattggcaatgatttatagattgatagacatttgaccattaagcgtgccattaataaactcgtctagacttamattttatgaagttttattcttttaactgcagttttcgttgcattcaaaataatatctggggcagattatcaagtttttggatcataaaactttttcttta

SEQ ID NO: 47575 - DNA, 201 bp, Homo sapiens
tgcactgatgactgcttattattgtggtactttgcgcatcataatttagatggcttcttttatgaaatattttgtatcatttaaatagtccagtgtagttkgttttcattgctcttcatgatgtgaactgtgtatgcagtcacacttttcatttagtggaaaattcagttttcaaatttggcagaaagtggtataggtggg

SEQ ID NO: 47576 - DNA, 201 bp, Homo sapiens
agacctgtaattatgcttgccttcaaattacactgactacattattatcttaacagaccattggcaatgatttatagattgatagacatttgaccattaascgtgccattaataaactcgtctagacttacattttatgaagttttattcttttaactgcagttttcgttgcattcaaaataatatctggggcagattatc

SEQ ID NO: 47577 - DNA, 201 bp, Homo sapiens
aaattaaaacaaacttgcgtttgtatttctcagaagaaaattctacagatggtctataaatacatttatacaccattttcagatggtgtatattttcagayacaagcacgataccattatcatactcaagaaattctcaattgatacagtaagattatctaatttgtccgtattcagatttcccagttgctccaataatgg

SEQ ID NO: 47578 - DNA, 201 bp, Homo sapiens
ttttatagagtataaatcaacctgtattttggtctctactgccatggtaagtttagattcttatctattaattaaaatccaatttattttctgcctagatrcatttgctaaaaagtgaaacatcagtagcaaatggcagtcagtcagaaagttcagtgtctactccatctgcgtcatttgaacctaacaacacttgtgaaa

SEQ ID NO: 47579 - DNA, 201 bp, Homo sapiens
acaatctcggctcactgcaacctccacctcccagattcaagcgattctcctgcctcagcctcccgagtagctgggattacaggtgcccaccaccacacccrgctaatttttatatttttagtagaggcaggggtttcaccatgttggtcaagctggtctcgaactcctgacctcaggtgatctgcccgcctcggcctccca

SEQ ID NO: 47580 - DNA, 201 bp, Homo sapiens
ctggcctcaaataatccacccgccttggcttcttcaagtgctgagattacaggcttgagccaccacgtctggccaggatatacaatgtttcactaaagtarcagatgtgaaataggaatcttttagcgaatctttagttaaaatgcattattttgtttatttcattatgttttttttttttttccctgagatggagttttg

SEQ ID NO: 47581 - DNA, 201 bp, Homo sapiens
tcaagtgattctcctgccccagcctcccaagtagctgggattacaggcacctgccaccacactgagctgatttttgtatttttagtagagacagggtttcmccatgttggccaggctggtctcaaactcctgacctcaggtgatctgcccgcctcggcctcccaaagtgctgagattacaggtgtgagccaccgcaccctt

SEQ ID NO: 47582 - DNA, 201 bp, Homo sapiens
accacactgagctgatttttgtatttttagtagagacagggtttcaccatgttggccaggctggtctcaaactcctgacctcaggtgatctgcccgcctcrgcctcccaaagtgctgagattacaggtgtgagccaccgcacccttcctaacattggaatatttttggagcccctctgtatattcaggaaactgccatgcc

SEQ ID NO: 47583 - DNA, 201 bp, Homo sapiens
acagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattctaccttgcatcttgcttttttgcttac

SEQ ID NO: 47584 - DNA, 201 bp, Homo sapiens
ataacataaaattacaattgtatatataatatacaatattatacaattatatacaattattatataaaataattatataaaataattttataattataatatattatataaaatataatatatataatatataaaataattgtatactatacaattatacagttattatacaattatatacaattgtataatattgtatat

SEQ ID NO: 47585 - DNA, 201 bp, Homo sapiens
tataacataaaattacaattgtatatataatatacaatattatacaattatatacaattattatataaaataattatataaaataattttataattataatatattatataaaatataatatatataatatataaaataattgtatactatacaattatacagttattatacaattatatacaattgtataatattgtata

SEQ ID NO: 47586 - DNA, 201 bp, Homo sapiens
ttataacataaaattacaattgtatatataatatacaatattatacaattatatacaattattatataaaataattatataaaataattttataattataatatattatataaaatataatatatataatatataaaataattgtatactatacaattatacagttattatacaattatatacaattgtataatattgtat

SEQ ID NO: 47587 - DNA, 201 bp, Homo sapiens
tttcactgagaactactttctagtttgtatattacaatttctcttaaacacagctccaaatattataacataaaattacaattgtatatataatatacaatattatacaattatatacaattattatataaaataattatataaaataattttataattataatatattatataaaatataatatatataatatataaaat

SEQ ID NO: 47588 - DNA, 201 bp, Homo sapiens
atttcactgagaactactttctagtttgtatattacaatttctcttaaacacagctccaaatattataacataaaattacaattgtatatataatatacaatattatacaattatatacaattattatataaaataattatataaaataattttataattataatatattatataaaatataatatatataatatataaaa

SEQ ID NO: 47589 - DNA, 201 bp, Homo sapiens
catttcactgagaactactttctagtttgtatattacaatttctcttaaacacagctccaaatattataacataaaattacaattgtatatataatatacaatattatacaattatatacaattattatataaaataattatataaaataattttataattataatatattatataaaatataatatatataatatataaa

SEQ ID NO: 47590 - DNA, 201 bp, Homo sapiens
ttgaacttctgacttcaggtcatctgctcaccttggcctcccaaagtgctgggattacaggtgtgagccacagcacctcgcctgtgatggttttttgtttktttgtttttgagatgaagtctggctctgttgccaggctggagtgcagtgacatgatctcggctcactgcaacctcctccacccagttcaagtggtcctcg

SEQ ID NO: 47591 - DNA, 201 bp, Homo sapiens
acttgatccctgaagactggggctacagtgagctgtgatcatgccactgcactccagcctgggtgacagagtcaaactctgtctcaaaaaaaaaaaaaaaagaatataggccaggcacagtggctcatgcctgtaatcccagaactttgggaggccaagacaggcagatcacttgaggtcaggagtttgagaccagtctgg

SEQ ID NO: 47592 - DNA, 201 bp, Homo sapiens
agaaggaacagaactgttgtttccgtaaatggtacgtcaggaattggatttttttttttgagatggagtctcgttctgtcgcccaggctggagtgcagtgstgtgatctcagctcaagtgcagcctccgcctcccaggttcaagtgattctcctgccccagcctcccaagtagctgggattacaggcacctgccaccacac

SEQ ID NO: 47593 - DNA, 201 bp, Homo sapiens
agtatataaggctgtaaaatgagaattctgccccctcacctcttaccccagtactattctccagaggtaatctattaacaatttcttatgtaattttcagraaatttgtatgcgtatataagcaaatatgtaatctttattttttaaataaatgggatcatattatatattctaccttgcatcttgcttttttgcttacat

SEQ ID NO: 47594 - DNA, 201 bp, Homo sapiens
  misc_feature (1)...(201): n = A,T,C or G, or insertion/deletion polymorphism (see Tables 1-2)
actgtaatataggagagctcgttgtatggatttttaaaacttttttcaggctgggtgtggtacctcatacttgtaatcccagctctttgggaagctgaggngcaaggatcacttgaggccagaagtttgagaccagcctgggcaacatagtgaggctccatctctacaaaaaaaacttttagtgagctgtgtgtgatagca

SEQ ID NO: 47595 - DNA, 201 bp, Homo sapiens
tagtgaggacagagggaagctcaaacaaggctgaatcttaaaactcttactgagcaatgggtgggagcatttaatactgaattactgtaatataggagagytcgttgtatggatttttaaaacttttttcaggctgggtgtggtacctcatacttgtaatcccagctctttgggaagctgaggcgcaaggatcacttgagg

SEQ ID NO: 47596 - DNA, 201 bp, Homo sapiens
aaatttgcaagcatattctaaagtagagagaacagaataacgaactcgaggtactcatcatcctgcgtcagtgattcccattatttgctcggtttttgttwtctgtctccctatatgaccacccttccaggttattttgaagcaaatctcaggcatttgtatgatttcatcttttaaaatatcaatatctaaaagataaga

SEQ ID NO: 47597 - DNA, 201 bp, Homo sapiens
actatttggatttgatagcttttcagctgcttaggggctggaagcacaattttatacctttttttgagtttacatgtaatgaacttttaaaattaaggcartgttaattaaagcatcattttggattcatctgagtaatatcttacttttaaaggcactctttaagtttttaaaacttattttacagactgttggcaacac

SEQ ID NO: 47598 - DNA, 201 bp, Homo sapiens
taaactgtacagatcctgtagtgtgtgttccatccagtttctttattggagacagtggaattcccttggaagtaatagcaggaagtgtttctgcagatgarcttgttacaagaattcacaaggtccgacaggtaagaaggaacagaactgttgtttccgtaaatggtacgtcaggaattggatttttttttttgagatgga

SEQ ID NO: 47599 - DNA, 201 bp, Homo sapiens
taccattagattttaagctctgttgaaggcagacaatgtctcatttggtttatatttagtatacagttcaatgcctagaacaaaataaatgcaataaaatrgtgaacatataaaagaatgaatggaaaggatttctcattcttcacagccttctctgagaagggttcgtagtaagaatattctcatatacttatttttctt

SEQ ID NO: 47600 - DNA, 201 bp, Homo sapiens
ctgtgtttctcccagtgttctgcatctgattggcactaccatacatctggttggataaaccataaatatgagagtcatctttgactcttaactcttcagtstcttcttgagctccggattgttcacaacattccaaatcacataggcctttccctacacacgtattccttctgcgtggtgaactcttctggctgttggcat

SEQ ID NO: 47601 - DNA, 201 bp, Homo sapiens
gcaagatggatagaaaaggaagttatgatagaggagaatgtagtagattcttcactagaatatacctcataaattaacatgtcacatgtattaatactacrggtataatgatgcagtacttgaaattatttaataaatgttagattatattgtgaaaatcacaaagatcatttgttttcctttgttaccaatagtgtttcg

SEQ ID NO: 47602 - DNA, 201 bp, Homo sapiens
tggatgaaccttgaaaatacaatttccatgaaaaaagcaagttacaaaggtcacatactgtatgattctattacacaacatgcccaaaatagacaaatccytagagatagtagattagtggttgccagggtctggaggagggagggatggggagtgactgctgatggggttggagttcctttttggcatgatgaaaatgtt

SEQ ID NO: 47603 - DNA, 201 bp, Homo sapiens
ccttcttggagtcctgggtctcctctgagagtctgggtggtgctcttcctacgcctctagaggtctctgtgtccctcattttccttcaaaagcgggctgtrtttctcttctaccttccagctcctcccacagaggaggaagacaataaatatttgttgaactgaaagcagagattgcctggcctcccagatccttccgcca

SEQ ID NO: 47604 - DNA, 201 bp, Homo sapiens
tggctaagagcattggcaccttctcagacccctgtaaggaccccacgcgtatcacctcccctaacgacccctgcctcactgggaagggtgactccagcggyttcagtagctacagtggctccagcagttctggcagctccatttccagtgccagaagctctggtggtggctccagtggtagctccagcggatccagcattg

SEQ ID NO: 47605 - DNA, 201 bp, Homo sapiens
cccaccctccattacagagctcaccacgccctcctagatcaccgtccccaacacacccattgcctctcaaggcccttatctcagccccttcctgtggccayttccctcagtgcccagatgattccctgggtgagggagacactggggcaccctcagaggttggagcaggctccctgctgtccctggatcctggacagatgg

SEQ ID NO: 47606 - DNA, 201 bp, Homo sapiens
acggggtattcccaggtcagctactcctccggatctggctctagtctacaaggtgcatccggttcctcccagctggggagcagcagctctcactcgggaarcagcggctctcactcgggaagcagcagctctcattcgagcagcagcagcagctttcagttcagcagcagcagcttccaagtagggaatggctctgctctg

SEQ ID NO: 47607 - DNA, 201 bp, Homo sapiens
gctactcctccggatctggctctagtctacaaggtgcatccggttcctcccagctggggagcagcagctctcactcgggaagcagcggctctcactcgggmagcagcagctctcattcgagcagcagcagcagctttcagttcagcagcagcagcttccaagtagggaatggctctgctctgccaaccaatgacaactctt

SEQ ID NO: 47608 - DNA, 201 bp, Homo sapiens
tagccagttcttcctcctttctccatccctaaactctccctgcgctctgcttgggagaaacccgagaggccgattactgagataaggcagaaaggtgaggraggaagccaagcctccttggcccttactaaccactgctttcctccacagggaccttggctaagagcattggcaccttctcagacccctgtaaggacccca

SEQ ID NO: 47609 - DNA, 201 bp, Homo sapiens
acagagctcaccacgccctcctagatcaccgtccccaacacacccattgcctctcaaggcccttatctcagccccttcctgtggccatttccctcagtgcycagatgattccctgggtgagggagacactggggcaccctcagaggttggagcaggctccctgctgtccctggatcctggacagatggctcagtaaactgt

SEQ ID NO: 47610 - DNA, 201 bp, Homo sapiens
acccaggtgtcctcgagctgccatcagtcaggaggccgtgcagcccgagatgggctcgtctcgggcaccctggatggggcgtgtgggtgggcacgggatgwtggcactgctgctggctggtctcctcctgccaggtaggaggctgggggccctgggaacaggagggaggcgggagggagactccgggagaggacccagcga

SEQ ID NO: 47611 - DNA, 201 bp, Homo sapiens
caagtagggaatggctctgctctgccaaccaatgacaactcttaccgcggaatactaaacccttcccagcctggacaaagctcttcctcttcccaaacctytggggtatccagcagtggccaaagcgtcagctccaaccagcgtccctgtagttcggacatccccgactctccctgcagtggagggcccatcgtctcgcac

SEQ ID NO: 47612 - DNA, 201 bp, Homo sapiens
cctctcaaggcccttatctcagccccttcctgtggccatttccctcagtgcccagatgattccctgggtgagggagacactggggcaccctcagaggttgragcaggctccctgctgtccctggatcctggacagatggctcagtaaactgtggggactaggtgcagactttttgccttcttggagtcctgggtctcctct

SEQ ID NO: 47613 - DNA, 201 bp, Homo sapiens
accactgctttcctccacagggaccttggctaagagcattggcaccttctcagacccctgtaaggaccccacgcgtatcacctcccctaacgacccctgcytcactgggaagggtgactccagcggcttcagtagctacagtggctccagcagttctggcagctccatttccagtgccagaagctctggtggtggctccag

SEQ ID NO: 47614 - DNA, 201 bp, Homo sapiens
gacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctc

SEQ ID NO: 47615 - DNA, 201 bp, Homo sapiens
aatatgccactgggctttcgctcccaattccaccccaccctccattacagagctcaccacgccctcctagatcaccgtccccaacacacccattgcctctyaaggcccttatctcagccccttcctgtggccatttccctcagtgcccagatgattccctgggtgagggagacactggggcaccctcagaggttggagcag

SEQ ID NO: 47616 - DNA, 201 bp, Homo sapiens
gggtcccttcctttgcagctgggccccccatctctgagggcaaatacttctccagcaaccccatcatccccagccagtcggcagcttcctcggccattgcrttccagccagtggggactggtggggtccagctctgtggaggcggctccacgggctccaagggaccctgctctccctccagttctcgagtccccagcagtt

SEQ ID NO: 47617 - DNA, 201 bp, Homo sapiens
gccacctcaatatcctttagagacaatagccagttcttcctcctttctccatccctaaactctccctgcgctctgcttgggagaaacccgagaggccgatkactgagataaggcagaaaggtgagggaggaagccaagcctccttggcccttactaaccactgctttcctccacagggaccttggctaagagcattggcac

SEQ ID NO: 47618 - DNA, 201 bp, Homo sapiens
ctttctccatccctaaactctccctgcgctctgcttgggagaaacccgagaggccgattactgagataaggcagaaaggtgagggaggaagccaagcctcyttggcccttactaaccactgctttcctccacagggaccttggctaagagcattggcaccttctcagacccctgtaaggaccccacgcgtatcacctcccc

SEQ ID NO: 47619 - DNA, 201 bp, Homo sapiens
cagaaaggtgagggaggaagccaagcctccttggcccttactaaccactgctttcctccacagggaccttggctaagagcattggcaccttctcagacccytgtaaggaccccacgcgtatcacctcccctaacgacccctgcctcactgggaagggtgactccagcggcttcagtagctacagtggctccagcagttctg

SEQ ID NO: 47620 - DNA, 201 bp, Homo sapiens
ctggatcctggacagatggctcagtaaactgtggggactaggtgcagactttttgccttcttggagtcctgggtctcctctgagagtctgggtggtgctcytcctacgcctctagaggtctctgtgtccctcattttccttcaaaagcgggctgtgtttctcttctaccttccagctcctcccacagaggaggaagacaat

SEQ ID NO: 47621 - DNA, 201 bp, Homo sapiens
ctctgagagtctgggtggtgctcttcctacgcctctagaggtctctgtgtccctcattttccttcaaaagcgggctgtgtttctcttctaccttccagctsctcccacagaggaggaagacaataaatatttgttgaactgaaagcagagattgcctggcctcccagatccttccgccatttccctcctctctcattgctc

SEQ ID NO: 47622 - DNA, 201 bp, Homo sapiens
actgtggggactaggtgcagactttttgccttcttggagtcctgggtctcctctgagagtctgggtggtgctcttcctacgcctctagaggtctctgtgtycctcattttccttcaaaagcgggctgtgtttctcttctaccttccagctcctcccacagaggaggaagacaataaatatttgttgaactgaaagcagaga

SEQ ID NO: 47623 - DNA, 201 bp, Homo sapiens
cacctcagcctcccaaagtgctgggattaccggcgtgagccactgtgcccagccccctcttatattcaatgtattcctttgaggtcactcactttggcacstaattttctatttttctggttggtgtttgcccacccttcccaaacaaagaaatgcctttattcggccacctcaatatcctttagagacaatagccagttc

SEQ ID NO: 47624 - DNA, 201 bp, Homo sapiens
gtagttcggacatccccgactctccctgcagtggagggcccatcgtctcgcactctggcccctacatccccagctcccactctgtgtcagggggtcagagrcctgtggtggtggtggtggaccagcacggttctggtgcccctggagtggttcaaggtcccccctgtagcaatggtggccttccaggcaagccctgtcccc

SEQ ID NO: 47625 - DNA, 201 bp, Homo sapiens
tggtggggtccagctctgtggaggcggctccacgggctccaagggaccctgctctccctccagttctcgagtccccagcagttctagcatttccagcagckccggttcaccctaccatccctgcggcagtgcttcccagagcccctgctccccaccaggcaccggctccttcagcagcagctccagttcccaatcgagtgg

SEQ ID NO: 47626 - DNA, 201 bp, Homo sapiens
gtccagctctgtggaggcggctccacgggctccaagggaccctgctctccctccagttctcgagtccccagcagttctagcatttccagcagctccggttyaccctaccatccctgcggcagtgcttcccagagcccctgctccccaccaggcaccggctccttcagcagcagctccagttcccaatcgagtggcaaaatc

SEQ ID NO: 47627 - DNA, 201 bp, Homo sapiens
caagtgaagcctctggggccccagctagctgaccctgaagttttcctaccccaaggagagttactcgacagtccataagtcaactgttgtgtgtgtgcatrccttgggcacaaacaagcacatacactatatcccatatgggagaaggccagtgcccaggcatagggttagctcagtttccctccttcccaaaagagtggt

SEQ ID NO: 47628 - DNA, 201 bp, Homo sapiens
gcagctccggttcaccctaccatccctgcggcagtgcttcccagagcccctgctccccaccaggcaccggctccttcagcagcagctccagttcccaatcsagtggcaaaatcatccttcagccttgtggcagcaagtccagctcttctggtcacccttgcatgtctgtctcctccttgacactgactgggggccccgatg

SEQ ID NO: 47629 - DNA, 201 bp, Homo sapiens
ctcctcctctccccacagtgactcctgcccagggaatgtccagctctggcataaaggacccaggtgtcctcgagctgccatcagtcaggaggccgtgcagyccgagatgggctcgtctcgggcaccctggatggggcgtgtgggtgggcacgggatgatggcactgctgctggctggtctcctcctgccaggtaggaggct

SEQ ID NO: 47630 - DNA, 201 bp, Homo sapiens
acttctcagccctccattgttttgccttttgtcttcttccctctggtcccactgtctggcccaggatttttcccctaagaatttacgcctggactcctcakagcctcagtttccccaattctctgtctcttcagggtcctttcttttagacctatttgttcctgccccttctccattccctcttctttttaaaaaaaattt

SEQ ID NO: 47631 - DNA, 201 bp, Homo sapiens
ggggtccagctctgtggaggcggctccacgggctccaagggaccctgctctccctccagttctcgagtccccagcagttctagcatttccagcagctccgkttcaccctaccatccctgcggcagtgcttcccagagcccctgctccccaccaggcaccggctccttcagcagcagctccagttcccaatcgagtggcaaa

SEQ ID NO: 47632 - DNA, 201 bp, Homo sapiens
ctgtgggctacttcaccaaagagaaccctgtgaaaggctctccaggggtcccttcctttgcagctgggccccccatctctgagggcaaatacttctccagyaaccccatcatccccagccagtcggcagcttcctcggccattgcgttccagccagtggggactggtggggtccagctctgtggaggcggctccacgggct

SEQ ID NO: 47633 - DNA, 201 bp, Homo sapiens
caccctcagaggttggagcaggctccctgctgtccctggatcctggacagatggctcagtaaactgtggggactaggtgcagactttttgccttcttggartcctgggtctcctctgagagtctgggtggtgctcttcctacgcctctagaggtctctgtgtccctcattttccttcaaaagcgggctgtgtttctcttct

SEQ ID NO: 47634 - DNA, 201 bp, Homo sapiens
tggccatttccctcagtgcccagatgattccctgggtgagggagacactggggcaccctcagaggttggagcaggctccctgctgtccctggatcctggamagatggctcagtaaactgtggggactaggtgcagactttttgccttcttggagtcctgggtctcctctgagagtctgggtggtgctcttcctacgcctct

SEQ ID NO: 47635 - DNA, 201 bp, Homo sapiens
tttaaattcccattccaccacagtgcccctcagccagatcaccaccccttacaattccctctactgtgttgaaatggtccattgagtaacacccccatcascttctcaactgggaaacccctgaaatgctctcagagcacctctgacgcctgaagaagttataccttcctcttcccctttaccaaataaagcaaagtcaaa

SEQ ID NO: 47636 - DNA, 201 bp, Homo sapiens
gcggcagtgcttcccagagcccctgctccccaccaggcaccggctccttcagcagcagctccagttcccaatcgagtggcaaaatcatccttcagccttgyggcagcaagtccagctcttctggtcacccttgcatgtctgtctcctccttgacactgactgggggccccgatggctctccccatcctgatccctccgctg

SEQ ID NO: 47637 - DNA, 201 bp, Homo sapiens
gatcccctgccgctccatccgggatatcctagcccaagtgaagcctctggggccccagctagctgaccctgaagttttcctaccccaaggagagttactcracagtccataagtcaactgttgtgtgtgtgcatgccttgggcacaaacaagcacatacactatatcccatatgggagaaggccagtgcccaggcataggg

SEQ ID NO: 47638 - DNA, 201 bp, Homo sapiens
gcttccaagtagggaatggctctgctctgccaaccaatgacaactcttaccgcggaatactaaacccttcccagcctggacaaagctcttcctcttcccaracctttggggtatccagcagtggccaaagcgtcagctccaaccagcgtccctgtagttcggacatccccgactctccctgcagtggagggcccatcgtct

SEQ ID NO: 47639 - DNA, 201 bp, Homo sapiens
ctgctgtccctggatcctggacagatggctcagtaaactgtggggactaggtgcagactttttgccttcttggagtcctgggtctcctctgagagtctggrtggtgctcttcctacgcctctagaggtctctgtgtccctcattttccttcaaaagcgggctgtgtttctcttctaccttccagctcctcccacagaggag

SEQ ID NO: 47640 - DNA, 201 bp, Homo sapiens
gggtatccagcagtggccaaagcgtcagctccaaccagcgtccctgtagttcggacatccccgactctccctgcagtggagggcccatcgtctcgcactcyggcccctacatccccagctcccactctgtgtcagggggtcagaggcctgtggtggtggtggtggaccagcacggttctggtgcccctggagtggttcaag

SEQ ID NO: 47641 - DNA, 201 bp, Homo sapiens
tcacctctgtagacaaatcctatggtggctacgaggtggtgggtggctcctctgacagttatctggttccaggcatgacctacagtaagggtaaaatctaycctgtgggctacttcaccaaagagaaccctgtgaaaggctctccaggggtcccttcctttgcagctgggccccccatctctgagggcaaatacttctcca

SEQ ID NO: 47642 - DNA, 201 bp, Homo sapiens
  misc_feature (1)...(201): n = A,T,C or G, or insertion/deletion polymorphism (see Tables 1-2)
tgcgttccagccagtggggactggtggggtccagctctgtggaggcggctccacgggctccaagggaccctgctctccctccagttctcgagtccccagcngttctagcatttccagcagctccggttcaccctaccatccctgcggcagtgcttcccagagcccctgctccccaccaggcaccggctccttcagcagcag

SEQ ID NO: 47643 - DNA, 201 bp, Homo sapiens
tgcctgaagaactctcttacctctccagtgctgcggccctcgctccgggcagtggccctttgcctggggagtcttctcccgatgccacaggcctctcaccyaaggcttcactcctccaccaggactcggagtccagacgactgccccgttctaattcactgggagccgggggaaaaatcctttcccaacgccctccctggt

SEQ ID NO: 47644 - DNA, 201 bp, Homo sapiens
gttgctttatcttccctttccctcaggcctctttgcccggagcatcggtgttgtggaggagaaagtttcccaaaacttggggaccaacttgcctcagctcrgacaaccttcctccactggcccctctaactctgaacatccgcagcccgctctggaccctaggtctaatgacttggcaagggttcctctgaagctcagcgt

SEQ ID NO: 47645 - DNA, 201 bp, Homo sapiens
actcggggactggagaccactggttgctttatcttccctttccctcaggcctctttgcccggagcatcggtgttgtggaggagaaagtttcccaaaacttsgggaccaacttgcctcagctcggacaaccttcctccactggcccctctaactctgaacatccgcagcccgctctggaccctaggtctaatgacttggcaa

SEQ ID NO: 47646 - DNA, 201 bp, Homo sapiens
gcccagcctgtttctgctgtcccccaccccactaccaggataaagggctggctgtcttggggctgagggagatcgggtgctgagcaggatgcagggccgcrtggcagggagctgcgctcctctgggcctgctcctggtctgtcttcatctcccaggtatggaggccgtgatgcccttgggcaggagggactggaggtcccc

SEQ ID NO: 47647 - DNA, 201 bp, Homo sapiens
ctgcagtgcagaggtggcctccatcgtgggggctgcctgccatggattcctggccccctgaggatccttggcagatgatggctgctgcggctgaggaccgyctgggggaagcgctgcctgaagaactctcttacctctccagtgctgcggccctcgctccgggcagtggccctttgcctggggagtcttctcccgatgcca

SEQ ID NO: 47648 - DNA, 201 bp, Homo sapiens
aggaaaggggtaaaggcaggagggtacacatttaggtccctgagggaaaaggaagaataggcataggggaagcaaagggaactggggactcggggactggrgaccactggttgctttatcttccctttccctcaggcctctttgcccggagcatcggtgttgtggaggagaaagtttcccaaaacttggggaccaacttgc

SEQ ID NO: 47649 - DNA, 201 bp, Homo sapiens
aaggggtaaaggcaggagggtacacatttaggtccctgagggaaaaggaagaataggcataggggaagcaaagggaactggggactcggggactggagacsactggttgctttatcttccctttccctcaggcctctttgcccggagcatcggtgttgtggaggagaaagtttcccaaaacttggggaccaacttgcctca

SEQ ID NO: 47650 - DNA, 201 bp, Homo sapiens
atccaggaggcagctgggggaatattaatcggtatccaggaggcagctgggggaatattcatctatacccaggtatcaataacccatttcctcctggagtyctccgccctcctggctcttcttggaacatcccagctggcttccctaatcctccaagccctaggttgcagtggggctagagcacgatagagggaaacccaa

SEQ ID NO: 47651 - DNA, 201 bp, Homo sapiens
  misc_feature (1)...(201): n = A,T,C or G, or insertion/deletion polymorphism (see Tables 1-2)
ggacaaccttcctccactggcccctctaactctgaacatccgcagcccgctctggaccctaggtctaatgacttggcaagggttcctctgaagctcagcgngcctgcatcagatggcttcccacctgcaggaggttctgcagtgcagaggtggcctccatcgtgggggctgcctgccatggattcctggccccctgaggat

SEQ ID NO: 47652 - DNA, 201 bp, Homo sapiens
accttcctccactggcccctctaactctgaacatccgcagcccgctctggaccctaggtctaatgacttggcaagggttcctctgaagctcagcgtgcctscatcagatggcttcccacctgcaggaggttctgcagtgcagaggtggcctccatcgtgggggctgcctgccatggattcctggccccctgaggatccttg

SEQ ID NO: 47653 - DNA, 201 bp, Homo sapiens
ccctgaggatccttggcagatgatggctgctgcggctgaggaccgcctgggggaagcgctgcctgaagaactctcttacctctccagtgctgcggccctcsctccgggcagtggccctttgcctggggagtcttctcccgatgccacaggcctctcacccaaggcttcactcctccaccaggactcggagtccagacgact

SEQ ID NO: 47654 - DNA, 201 bp, Homo sapiens
gcctgaagaactctcttacctctccagtgctgcggccctcgctccgggcagtggccctttgcctggggagtcttctcccgatgccacaggcctctcacccraggcttcactcctccaccaggactcggagtccagacgactgccccgttctaattcactgggagccgggggaaaaatcctttcccaacgccctccctggtc

SEQ ID NO: 47655 - DNA, 201 bp, Homo sapiens
atcggtatccaggaggcagctgggggaatattaatcggtatccaggaggcagctgggggaatattcatctatacccaggtatcaataacccatttcctccyggagtcctccgccctcctggctcttcttggaacatcccagctggcttccctaatcctccaagccctaggttgcagtggggctagagcacgatagagggaa

SEQ ID NO: 47656 - DNA, 201 bp, Homo sapiens
ggaggcagctggggaaatattaatcggtatccaggaggcagctgggggaatattaatcggtatccaggaggcagctgggggaatattcatctatacccagrtatcaataacccatttcctcctggagtcctccgccctcctggctcttcttggaacatcccagctggcttccctaatcctccaagccctaggttgcagtgg

SEQ ID NO: 47657 - DNA, 201 bp, Homo sapiens
gccctgggactggttggggaacgaggcccatgccacaccctgagggaatctggggtatcaataatcaacccccaggtaccagctggggaaatattaatcgstatccaggaggcagctggggaaatattaatcggtatccaggaggcagctgggggaatattaatcggtatccaggaggcagctgggggaatattcatctat

SEQ ID NO: 47658 - DNA, 201 bp, Homo sapiens
gggagtcttctcccgatgccacaggcctctcacccaaggcttcactcctccaccaggactcggagtccagacgactgccccgttctaattcactgggagcygggggaaaaatcctttcccaacgccctccctggtctctcatccacagggttctgcctgatcacccctggggtaccctgaatcccagtgtgtcctggggag

SEQ ID NO: 47659 - DNA, 201 bp, Homo sapiens
tgacactgtcccagctgcatcccaggtttgaaaggcacctcctcccccagcgcaggcatcctgcctcccaaccctgtaattacggtgcttcccaacgcccrtcgtgtggtttgctcccattctttggcttccaatagttgcaagggatgaaggtggacatctctgtgattacggagatgccaagtgggtattgactgctcc

SEQ ID NO: 47660 - DNA, 201 bp, Homo sapiens
ctctgtgattacggagatgccaagtgggtattgactgctccagggtgtggatggagggtgtgaaaaccagggtggggtgacgcaggctctgggtcatgatrgggagagcaggcagctgggtcctgggctggaggactaaaataagggacgccaccttcaggggtgacacatcagcccaggccttcccaacgggtttgacca

SEQ ID NO: 47661 - DNA, 201 bp, Homo sapiens
ggaggctggggtagtagctgacactgtcccagctgcatcccaggtttgaaaggcacctcctcccccagcgcaggcatcctgcctcccaaccctgtaattayggtgcttcccaacgcccatcgtgtggtttgctcccattctttggcttccaatagttgcaagggatgaaggtggacatctctgtgattacggagatgccaa

SEQ ID NO: 47662 - DNA, 201 bp, Homo sapiens
agccccagggggagctttcagtgcgggggtgagtggggaggctggggtagtagctgacactgtcccagctgcatcccaggtttgaaaggcacctcctcccycagcgcaggcatcctgcctcccaaccctgtaattacggtgcttcccaacgcccatcgtgtggtttgctcccattctttggcttccaatagttgcaaggga

SEQ ID NO: 47663 - DNA, 201 bp, Homo sapiens
tgtggtttgctcccattctttggcttccaatagttgcaagggatgaaggtggacatctctgtgattacggagatgccaagtgggtattgactgctccaggrtgtggatggagggtgtgaaaaccagggtggggtgacgcaggctctgggtcatgatagggagagcaggcagctgggtcctgggctggaggactaaaataag

SEQ ID NO: 47664 - DNA, 201 bp, Homo sapiens
aaataagggacgccaccttcaggggtgacacatcagcccaggccttcccaacgggtttgaccagttctgttctgatggtattcctgtgccactgggctggyccctcctccactcctcccctataaagcctcttggggttcccaggcacccagactcagcccaccccagctttgggggccagtacatagccatgatcctcaa

SEQ ID NO: 47665 - DNA, 201 bp, Homo sapiens
ctggggtagtagctgacactgtcccagctgcatcccaggtttgaaaggcacctcctcccccagcgcaggcatcctgcctcccaaccctgtaattacggtgsttcccaacgcccatcgtgtggtttgctcccattctttggcttccaatagttgcaagggatgaaggtggacatctctgtgattacggagatgccaagtggg

SEQ ID NO: 47666 - DNA, 201 bp, Homo sapiens
caggaaagcacgaagccccagggggagctttcagtgcgggggtgagtggggaggctggggtagtagctgacactgtcccagctgcatcccaggtttgaaargcacctcctcccccagcgcaggcatcctgcctcccaaccctgtaattacggtgcttcccaacgcccatcgtgtggtttgctcccattctttggcttccaa

SEQ ID NO: 47667 - DNA, 201 bp, Homo sapiens
ccccaaccaggggtggatggagcttatttggagaagtctggtcagtttaaagtgggtcaagtgaacggttcagatccatcgggggtaggggttcatgacaytttaccatcagttaagtatttacaaacctaccgagagctctttgagagtgacttttttggtctgtttgtgggtcagttcaggctgcgtccatccagacag

SEQ ID NO: 47668 - DNA, 201 bp, Homo sapiens
ggacatggtgcagaaggtgcatttggctctcaccagaaatggtttgctggctccatgtggcaaagtcggtcaggattaacgtgggggggacgagtttcctyggagctgggatctgtgttaaggagctggggtccttgtaaagctggggtctgtgtgcctgggggccaaggtgtaacccaccttgggttgcaggttggcctg

SEQ ID NO: 47669 - DNA, 201 bp, Homo sapiens
ttcctgtcccctcctgagatccatacttagtcctcacatcgcccgttttttcctctgacagcctaagcctactctcctacctcgcctccaggcctcggccscacctacctcccacccggtcttcctgcccgcgcgatcgctggggcagggctatggtactgtgttcccttctgccacctggtggccggcggcaggaactat

SEQ ID NO: 47670 - DNA, 201 bp, Homo sapiens
tctgacagcctaagcctactctcctacctcgcctccaggcctcggccccacctacctcccacccggtcttcctgcccgcgcgatcgctggggcagggctayggtactgtgttcccttctgccacctggtggccggcggcaggaactatcagtagacagctgctgcttccatgaaacggaaaaataaaaatcatgttttctt

SEQ ID NO: 47671 - DNA, 201 bp, Homo sapiens
ctgaagaaggacatggtggagagcaggatgcctggatcccatgggggaagggaagtgcccaggaaagcacgaagccccagggggagctttcagtgcggggrtgagtggggaggctggggtagtagctgacactgtcccagctgcatcccaggtttgaaaggcacctcctcccccagcgcaggcatcctgcctcccaaccct

SEQ ID NO: 47672 - DNA, 201 bp, Homo sapiens
actgtcccagctgcatcccaggtttgaaaggcacctcctcccccagcgcaggcatcctgcctcccaaccctgtaattacggtgcttcccaacgcccatcgygtggtttgctcccattctttggcttccaatagttgcaagggatgaaggtggacatctctgtgattacggagatgccaagtgggtattgactgctccaggg

SEQ ID NO: 47673 - DNA, 201 bp, Homo sapiens
gtgggaacagaggcagggactgcagtttggggtgatgagggatactcaagatggcggaggtgaactggacgcatggggttggggacaggaattcaggggaygcagaaggtgcatctggctcaccagaaatggctttctggacacattgggtgggggacatggtgcagaaggtgcatttggctctcaccagaaatggtttgc

SEQ ID NO: 47674 - DNA, 201 bp, Homo sapiens
agggatactcaagatggcggaggtgaactggacgcatggggttggggacaggaattcaggggatgcagaaggtgcatctggctcaccagaaatggctttcwggacacattgggtgggggacatggtgcagaaggtgcatttggctctcaccagaaatggtttgctggctccatgtggcaaagtcggtcaggattaacgtgg

SEQ ID NO: 47675 - DNA, 201 bp, Homo sapiens
gtgggggggacgagtttcctcggagctgggatctgtgttaaggagctggggtccttgtaaagctggggtctgtgtgcctgggggccaaggtgtaacccacyttgggttgcaggttggcctgaggacaaagctagtggggtaccccaaccaggggtggatggagcttatttggagaagtctggtcagtttaaagtgggtcaa

SEQ ID NO: 47676 - DNA, 201 bp, Homo sapiens
ggtgacccttggccaggggcaccccctctctttgaagatcctccgcctacccgccccagtcgtccctggagagacctgcctgaaactggagtctggccccmtgaaccgcctagaacggatcctcctcaacctccccggcctgacgacccttggccggcaggaccccagcccccagaaaacccctggcctcctgcccctgag

SEQ ID NO: 47677 - DNA, 201 bp, Homo sapiens
agccgccagtggaaggtgacctctgaagacctgatcttaattggaaatgaactagaccttgcgtgtggagagagaattcgactggagaaggtgagaccacygagcttctctggatattcagggactcagccaccaagtatgtaatctccacgccccagctcacacggaggagggaccctcgccgaccccgtctcaggtgga

SEQ ID NO: 47678 - DNA, 201 bp, Homo sapiens
acatccagaccaaattattggtctcttgctgtttcatgacagtgtggtcctctgaagatttgttcagactccctggaactgttctttgtggtcctttttcrtggttttcaaaatgtttccattgagggcgtattacttttataatcaacaaaagagaaagtataacttcattttagaaattctcacctaaggcatttgaaa

SEQ ID NO: 47679 - DNA, 201 bp, Homo sapiens
cctgaagcagcagactgaccctgtgcctgcccttgtgcctgcagggggtggagcaggggctgggccgccagcagtgaggtgctcacaaggggtgctggctrtcaggtccaccctagggccccaccaccaggagctgcacatcacactgcagcgcgtgggggagcaggtgagggtgactgcccacccacccgccttcccctg

SEQ ID NO: 47680 - DNA, 201 bp, Homo sapiens
ggtcgcgctggctggggagggctgtgtgcagagcccctgctgtaactgatgacaacagtcagggtctgtggtcaagcctgtgacatcctttctttcagtcrtcacgaccccgcagactgtcctccggataaacagcattgagattgctccgtgtttgttgtgattaccgagttaatacttacaaaaggataaaaataaact

SEQ ID NO: 47681 - DNA, 201 bp, Homo sapiens
agtgagctgagatcatgccaccgcactctagcctgggtgacagagcgagactccgtctcaaaaaaaaaaggcattgcccgcaccaagcttggcatcctgasggtggggaggggaagtggctggggaccgcagtgctatagctgctgagactgagcactcctaacacccgaccctcactggccatgctgggaccggctgtga

SEQ ID NO: 47682 - DNA, 201 bp, Homo sapiens
cagttgccggcctaaaccaccaacagtgggcatagttaaatatacccagaatactggtattggctgtcaccttagagtcatctgggtaggggagcctctcrtgtaccttctgacacttccaggtagcctcaaggtcactcaggtggggccatcctcccacgcactccagaagtcacagcatagacagtgtgggaggagagg

SEQ ID NO: 47683 - DNA, 201 bp, Homo sapiens
tgttccaacccatgacgcctagcactgtccccaaagcagcagtgaatccgcaagcaggtgtagggctgtcctagcaggtctgcactgaggacatcccccayagtgggcatcctgagggatggcacccacggggcatgggccacatagctgagcggctgcagaattctgtccctcacagctcttgctataactgcagttgcc

SEQ ID NO: 47684 - DNA, 201 bp, Homo sapiens
aacatgcgtgtccgctgagtttgttatatgatatactttgtctctagacatttaagttgagtatgattggattttttcttatcagtaaaatttaagatgawctccaacatctaataaaaacactgtaggccgtgcgtggtggctcacgcctgttatcccagcactttgggaagccgaggcgggcagatcacctgaggtcag

SEQ ID NO: 47685 - DNA, 201 bp, Homo sapiens
acccacctcgctccccttctccaccctccacgcgtgaccccacctcgctccccttctcctccaccctccacgcatgaccccactttgttccaacccatgaygcctagcactgtccccaaagcagcagtgaatccgcaagcaggtgtagggctgtcctagcaggtctgcactgaggacatcccccatagtgggcatcctgag

SEQ ID NO: 47686 - DNA, 201 bp, Homo sapiens
attgttttttataacaggaaacccagtgggagtgcacatgtcatgctgaaacaaactctaaaaatacttattttattatttgtcactatctaacatgcgtrtccgctgagtttgttatatgatatactttgtctctagacatttaagttgagtatgattggattttttcttatcagtaaaatttaagatgatctccaacat

SEQ ID NO: 47687 - DNA, 201 bp, Homo sapiens
gtagaaagactgaaattttactttgcagtggcagcagcaataaaagcttaaaaacggttctgaataattcggtttgggatctacctaccctccctctttgyagactacagaaagaaagaccccacctccttttgaatctaggcccccctctttctttcctcccttcctctcccctccacctacctgaggctgagcaggcag

SEQ ID NO: 47688 - DNA, 201 bp, Homo sapiens
agatggaagtcccagttggttatcacctcatcccagaagccacgtgctagcatgtctgtcactagctgttggacacacaggccactcccagggggctaacmggggtaagaatagcaggaggcggggcccagcagggccatcttggaggctgctcccacgcttgggcacagatcagagtctgaacctaccaggcacttagtc

SEQ ID NO: 47689 - DNA, 201 bp, Homo sapiens
aatagtaaacactggttgacaggcatttccctgggtgctaatttacctcaccgaccattcaaaactgcatggtctaggccaggcatggtggctcacactgrtgacccaccacattgggaggccaaggtgggggattgcttgaactcaggagttcaagactagcctgggcaacatggtgagacctcagagacctcatctcta

SEQ ID NO: 47690 - DNA, 201 bp, Homo sapiens
aaatggtgatggatatcctcgcctaatctgaactcattctgcaaaagaaacagccgtatttaaggcgctgggctgatacgaggctccaaaaaggttatgtycgttaaaaactctataaatctctgcttgaaaatggttggagtgtgtatttgtgtgcatgagtgtttatgtatgttttaaacctgggtttcatgtctcacc

SEQ ID NO: 47691 - DNA, 201 bp, Homo sapiens
ggccatgctgggaccggctgtgaacagtagccatctaatacctaacacagccctttcaggcgggtgcttgttttcccatttgctcagttgtagacaccagracacagaattgtctggggttccgagccagttctgcctggcactcacctgggtgtgaaggaagagcaggcacctacctaggaggaggtggaggtggagcag

SEQ ID NO: 47692 - DNA, 201 bp, Homo sapiens
ctagcctgggtgacagagcgagactccgtctcaaaaaaaaaaggcattgcccgcaccaagcttggcatcctgagggtggggaggggaagtggctggggacygcagtgctatagctgctgagactgagcactcctaacacccgaccctcactggccatgctgggaccggctgtgaacagtagccatctaatacctaacacag

SEQ ID NO: 47693 - DNA, 201 bp, Homo sapiens
aaacattggctgctggaactgctgctgggactccagggatcctctgcagtggggagatgtgggagtctttcttgcttctcaaagaagcggcaaaacattckgagcataggaagaagttgtaagtgagcatgtgggtaggttgtgcctactacccctgtgtcctgtgtgagaggttagcaccttcctgccagcgtgttcttc

SEQ ID NO: 47694 - DNA, 201 bp, Homo sapiens
tggttctggtctcaggcgcttgtagatgatgtggctaactgatctcaacacatataaccagtagctgtaagtgacgttcttgtagttttgctcacctaggygtttctgtgggcaggctgtcatgcagtggttcataccatgtaccaggagcagcagctgtgcatttagcatcataaagggcagtttgcatttgtagtatta

SEQ ID NO: 47695 - DNA, 201 bp, Homo sapiens
ctctgaagacctgatcttaattggaaatgaactagaccttgcgtgtggagagagaattcgactggagaaggtgagaccaccgagcttctctggatattcarggactcagccaccaagtatgtaatctccacgccccagctcacacggaggagggaccctcgccgaccccgtctcaggtggaggccaacaaagctgaggctc

SEQ ID NO: 47696 - DNA, 201 bp, Homo sapiens
catccaagatggaagtcccagttggttatcacctcatcccagaagccacgtgctagcatgtctgtcactagctgttggacacacaggccactcccaggggkctaacaggggtaagaatagcaggaggcggggcccagcagggccatcttggaggctgctcccacgcttgggcacagatcagagtctgaacctaccaggcac

SEQ ID NO: 47697 - DNA, 201 bp, Homo sapiens
gtgatggaagtacacagtcacagtctctaggactacctaaaggaaatcctgtgggagaggaaggagactgtttgttccctggggacccaaaaacaaagctwgaagcaaattaggtacagaagcctgctaagtttttaatagtgggatggatttgccaatgggttgactgagtagtgtgcgagagaagagtcaaaactgatg

SEQ ID NO: 47698 - DNA, 201 bp, Homo sapiens
gcctgcccttgtgcctgcagggggtggagcaggggctgggccgccagcagtgaggtgctcacaaggggtgctggctgtcaggtccaccctagggccccacsaccaggagctgcacatcacactgcagcgcgtgggggagcaggtgagggtgactgcccacccacccgccttcccctgcagaggtcgtgaagaaggtgaatg

SEQ ID NO: 47699 - DNA, 201 bp, Homo sapiens
gtgcctgtaatcccagctactaaggtgactgaggcaggagaatcgctggaaccctggaggcagaggttgcagtgagctgagatcatgccaccgcactctarcctgggtgacagagcgagactccgtctcaaaaaaaaaaggcattgcccgcaccaagcttggcatcctgagggtggggaggggaagtggctggggaccgca

SEQ ID NO: 47700 - DNA, 201 bp, Homo sapiens
gtaggcaggaaagtttttacaaaagcagtgggacttactccattctacctacctacatgaaaccacccctccaatgctatgttcaagtacagactcacgcrttaggagagaaagacacacagtgaagcgagtagagacaaggtgaccaaaacagtgagcagctggggccttgaagagtgagcaaaggagacgtgatggaag

SEQ ID NO: 47701 - DNA, 201 bp, Homo sapiens
cgaggctgcgggaagatggcggcggccatggcagcatcttccctgacggtcaccttagggcggctggcgtccgcgtgcagccacagcatcctgagaccttyggggcccggagcaggtgagacctgggatatgggaggaagggaggacgcagagcgagcgctgctccctgcggtctcgccacgtatgtgcctgggtccgacc

SEQ ID NO: 47702 - DNA, 201 bp, Homo sapiens
gttactaagtaaaagaagccaacctgaaaaggggacatcttgtatgtttcccactatgacattctggaaaaggcaaatctaaggagacagtaaaaagttasatggggggtaagaggattgggggagaaaaggataaataggtggagctcagaggatttttagggcagtgaaactattctgtatgatataatggtagataca

SEQ ID NO: 47703 - DNA, 201 bp, Homo sapiens
aagttgagtatgattggattttttcttatcagtaaaatttaagatgatctccaacatctaataaaaacactgtaggccgtgcgtggtggctcacgcctgtwatcccagcactttgggaagccgaggcgggcagatcacctgaggtcagtttgagaccagcctagccaacatggtgaaaccccatctctaataaaaatacca

SEQ ID NO: 47704 - DNA, 201 bp, Homo sapiens
ggggcccggagcaggtgagacctgggatatgggaggaagggaggacgcagagcgagcgctgctccctgcggtctcgccacgtatgtgcctgggtccgaccyggtgccttgtgtgttgatcgcatttgtggtgaatatagcacgggttttggagtcgggggaacccaggttcagattttgattccttcagttagtagcctga

SEQ ID NO: 47705 - DNA, 201 bp, Homo sapiens
gcgtgtccacagggtgatggaccatcaaggtaatgctgtctgacacatttgcgataggctccaggacaaggcaaagttccaagactgtggtccatcagcartaaattaaagatgcagacaggaaacagttaagacggcaaataagatacacggtacattctgtgcaaatttaaatgtgttatttgcagggagtgcaagaaa

SEQ ID NO: 47706 - DNA, 201 bp, Homo sapiens
gcttcaagtgatcttccttgcatcggcctcccagagtgctggtgttacaagtgcgagccactgcactgggctgaaagcctgcttctttagaaggttattaraatgtgcactcctcagaacaggcactctacccagtcacaaatgctaatgcctttgtgggccaggcaggtgatataaaggaacacatgtttgtttttgtca

SEQ ID NO: 47707 - DNA, 201 bp, Homo sapiens
cttgcatcggcctcccagagtgctggtgttacaagtgcgagccactgcactgggctgaaagcctgcttctttagaaggttattagaatgtgcactcctcaraacaggcactctacccagtcacaaatgctaatgcctttgtgggccaggcaggtgatataaaggaacacatgtttgtttttgtcagttatgggcagtgtta

SEQ ID NO: 47708 - DNA, 201 bp, Homo sapiens
tacccagtcacaaatgctaatgcctttgtgggccaggcaggtgatataaaggaacacatgtttgtttttgtcagttatgggcagtgttaggaattcaatawgctggagagaggaccctgtcgaatgacattcagcattagttaaatgaaaaacactaggcatgcccaaccaaactgtcggaggttgtgatctctgctattt

SEQ ID NO: 47709 - DNA, 201 bp, Homo sapiens
ttagtgggagcactgcccctcatcaccatctacctgcaggctggagggcagactgagaggttggtggctgccacgacacagccctgcacacaggggctgcrtgacactcacaagggtctaacacctgttctagggaccttgttcagtgaccactctcactggcaggaagtatttcttgcgtataaataagaattcctgatg

SEQ ID NO: 47710 - DNA, 201 bp, Homo sapiens
tgtttaggggctaccttaccttcaggaggccagggctttggcagcacatgggaaaaggtttcagtagttttaacttaaaactgtgctgcaggctttcccarccgtggcgtggtcggcattttgggctggatcactcttcgttttggaggactgtcctgtgcgctttataggatgtttagcagcagctctggcttctaccca

SEQ ID NO: 47711 - DNA, 201 bp, Homo sapiens
gtttaggggctaccttaccttcaggaggccagggctttggcagcacatgggaaaaggtttcagtagttttaacttaaaactgtgctgcaggctttcccaaycgtggcgtggtcggcattttgggctggatcactcttcgttttggaggactgtcctgtgcgctttataggatgtttagcagcagctctggcttctacccat

SEQ ID NO: 47712 - DNA, 201 bp, Homo sapiens
ctttataggatgtttagcagcagctctggcttctacccattagatgccaatcgtgtccccaccccaccccctaagttgtacaattaaaacgtttccagacwgtgccaaatgtccccggggagaatgaactcactctggctgagaactacggctttagcggaagctctcttagccatatacaagaaggggaagggcctgctc

SEQ ID NO: 47713 - DNA, 201 bp, Homo sapiens
ggcagggtggccttgtgggcctgtgaccggtgccccccacacacagagccctgcacttggagggaccctgtgcttggtttaaagctctgccgtggtcatcwtgaaattttaagtttgtgaacaaggtatccctgatttgcattttgttgtggactttgcaaattacatagcaggtttcaggcctagaaatctgacctacct

SEQ ID NO: 47714 - DNA, 201 bp, Homo sapiens
  misc_feature (1)...(201): n = A,T,C or G, or insertion/deletion polymorphism (see Tables 1-2)
gctccctggagttgactggtgtggactccaggcttgtatctgtcagtgtgtgtttgggcacagggatagggagaccagaccctgaaaaagacagtaatatnttccagggagcatctagcatcatctagcatgttttattttcttttgctgtttcgagacaggatcttgctctatcacccaggctggagtgcagtggtatga

SEQ ID NO: 47715 - DNA, 201 bp, Homo sapiens
aattttggggaactaataaatgtccatgaaatcatcacaatttatgttcagagattgcagtaaagacagacataagaaattataaaagtattaatttggaraacttaataaatgtccatgaaatcttcacaatttatgttcttctgccatggcttcagccagtccctccgttcggggtccctgacttcctgcaacacctga

SEQ ID NO: 47716 - DNA, 201 bp, Homo sapiens
tcgttgatggaaagggctgtagctccccagctagctctgtcgtggttggttgaactagaccaggagcttgtaggtgaaaggtttgagatggcaggtgataygcatgtgtctgtttggaggcagagagatgaacaaagggagggatgtccagtggtgtcttcaggtctacatgcctagatgctggagggatgaagtcatggg

SEQ ID NO: 47717 - DNA, 201 bp, Homo sapiens
taagatgcactgagctcataccagctatgtagtcttggaaagctatttaaactctctctgcctcagcttccttctctgtagaatgggaatttggatgcctrttttacagagtgttttaaaagttagaaatatgtgtaacatgagtagagtagtagccacttggtacgtgttagatatttttgttactataagacaacgcta

SEQ ID NO: 47718 - DNA, 201 bp, Homo sapiens
ttgattcaagatttagagctccttttagcagttcttgtagtggtgacttggtagtggtgaattttctcagcatttgtttgtatccttctttcatatatgaygcttatttttgctggatacagaattcttggctgataattgttttgatggaggaggctgaagatatggccccagtcctttctagcttgtagggtatctgct

SEQ ID NO: 47719 - DNA, 201 bp, Homo sapiens
ggattgggttaagtcaaagaccttgtcttcgagctctgaatttctttcttctacttgttcaattctattgctgagactttccagagcattttgcattactrgaagtatgtccaatgtttcctgatgttttaactgttttttctttattctatctatttccttgaatatttctcccttcacttcttgtattgatttttggat

SEQ ID NO: 47720 - DNA, 201 bp, Homo sapiens
  misc_feature (1)...(201): n = A,T,C or G, or insertion/deletion polymorphism (see Tables 1-2)
aagctctcagaaaaatctctagtggtggctgccgtcgctccagacaatcggaatcctgccttcaccaccatgggctggctttttctaaaggttttgttggngggagtgagtttctcaggatttctttatcctcttgtggatttttgcatcagtgggaaaacaagaggacagaagccaaactttgtgattattttggccgat

SEQ ID NO: 47721 - DNA, 201 bp, Homo sapiens
  misc_feature (1)...(201): n = A,T,C or G, or insertion/deletion polymorphism (see Tables 1-2)
tcagtttctctccccgcaaaatgcaagtaataaaaaataatgtccctagctcacgagagtctttgcaagctttacagagtggtcagctcgtccatggaacntaaatatctattcaaagggaatggaagaaagcattatgcatagacttttacacttggaggaaatggccaaccagaaaaatcatttggggccagagtgttg

SEQ ID NO: 47722 - DNA, 201 bp, Homo sapiens
  misc_feature (1)...(201): n = A,T,C or G, or insertion/deletion polymorphism (see Tables 1-2)
cctttcacattattctatgtttccatgtcatataattttacatagtataatttttatgattaaacaatacttttcataattttaatataatgtcatgttcncatgtaatgtttaatccaaatatttcacataatgcttaatacatttctctcaatcttttttatttatttgggacaaagtcttactctgtcacccaggctg

SEQ ID NO: 47723 - DNA, 201 bp, Homo sapiens
ccgcagaagctgtgcccctagaaagaggtggtgcggagtaccaggctgtgctgcccgaggtcagaaaggttcttgcagacgtcctccaagacattgccaaygacaacatctccagcgcagattacactcaggacccttcagtaactccctgctgtaatccctaccaaattgcctgccgctgtcaagccgcataacagacca

SEQ ID NO: 47724 - DNA, 201 bp, Homo sapiens
atcccagcactttgggaggctgaggtgggtggatcacctgaggtcaggagtttgagatcagccaacatggtgaacccctgtctctactaaaaaaataaaarattagctcagcacagtggtgcatgcctgtaaccccagctatttgggaggctgaggcaggggaaccgcttgaacccaggaggtggaggttgcagtgagttg

SEQ ID NO: 47725 - DNA, 201 bp, Homo sapiens
gggcagggattctgttacaatgtaaaccagagcctgctgctcttgctgaatccctctggcttcccatctctcgcagcaaaagcctttctttcctctctgaytaatccctgcccttcctttctccattgcttctgcagtggcttctttgccgctccttgcttgtgccagacctcagcctttcccagtttctctgcctttcct

SEQ ID NO: 47726 - DNA, 201 bp, Homo sapiens
aggggcatttaatgccattaaatgacttagcacatgtaaagcgccctgttcgtagttcaagctaaaaaatggttataactattcgttgtaaaatggaaacracctccttggactttcgtttgaaaatgaaactggaaggtcattgagtatagggactgtttctttgcttccttaacatggattacagggtctgccccagta

SEQ ID NO: 47727 - DNA, 201 bp, Homo sapiens
gcggagcttgcattgagccgagatttccccactgcactccagcctgggtgacagagcgagactccgtctcaaaaaataaaataaaataaaataaataaatwcataaataaagcttgggctggagaagagatagaaggaaggaggaactcagaagaaaacttcaacacaaaggctttgggtttcaatgctcacacccttcca

SEQ ID NO: 47728 - DNA, 201 bp, Homo sapiens
gtggtggcgcgtgcctgtagtcccagctacagctctcagttgggaggctgaggcagaagaatcgcttgaacctgggaggtggaggttgcagtgagccgagrtcgcaccactgcactccagcctgggcgacagagcgagactgtatctcaaaaagagaaaaataaataaaaattaaaattaaaaaaataaaaaagaggaata

SEQ ID NO: 47729 - DNA, 201 bp, Homo sapiens
cgtaggtgtctcggtgcttgaactgcgggctgctgatgttggccagagaggaagatgatgaaaccaggcaggaagcgggcatttctgagacgatgtggggyggtgcacctgcaccctgggcctcctggtgcctttgcagggccccagcgcgggagggcaaagtgaaggagcccatgtggggttgctgtgtctgtggagccc

SEQ ID NO: 47730 - DNA, 201 bp, Homo sapiens
tgcaccctgggcctcctggtgcctttgcagggccccagcgcgggagggcaaagtgaaggagcccatgtggggttgctgtgtctgtggagccctctttgagkggcagaggctcaggcttctccgggctcctggtgatgggctgtcttcccctttcactgtggtttcccgtgtgagtctggggtcatcctttatgtgtccctg

SEQ ID NO: 47731 - DNA, 201 bp, Homo sapiens
  misc_feature (1)...(201): n = A,T,C or G, or insertion/deletion polymorphism (see Tables 1-2)
atggaacactgaagaaacacaatctgtttatttatattcccacctaaattttagcttctttcttaagtgaattttttttccctgaagtcttgtacatgggntccattctgaaatggattattgaccaggcatgaggccactctagtgttccaagctaagaagctttaagaggaaaagtctcctgtgtctgttgcacatggt

SEQ ID NO: 47732 - DNA, 201 bp, Homo sapiens
  misc_feature (1)...(201): n = A,T,C or G, or insertion/deletion polymorphism (see Tables 1-2)
acatgctttaaaaaaaatgacagatgggagaagtgaagacctggcttttgcactcactaaaaattactccagaacttgtttcctccttggtcttcagtttnctcacttgacagttgaggggttggaccagatcaggtgttggcaccttgagggcatattcctgtggtgaggggatactgagaccagctcctatgcagcagg

SEQ ID NO: 47733 - DNA, 201 bp, Homo sapiens
ccaaccctgtcgctataggtccattgcgaatattattatcatcactatttttcaggtggagaaactgatgaaccagttaaatatttgaataaaaacatctrttggcatggaaaagtgattatttcctaagctactgagtaaaacacagctgcactggcagttttaactctgttttcttgtcaatttttgttctttcaggaa

SEQ ID NO: 47734 - DNA, 201 bp, Homo sapiens
agacaattccaaaaagccttctggcatggacactctgaggtttcttcatgcttatgtccaagttcactccttttccctcctgcctcttacatcctctctgyggtgcactgtcctggttccccgtctcactctgtctcccaggctagagtgcagtggcatgatctcggctcactgcaacctccgcctcccaggttcaagtga

SEQ ID NO: 47735 - DNA, 201 bp, Homo sapiens
gctgaggtgggtggatcactaggtcaggagtttgagaccagcctggccaacatggtgaaaccccatcgctactaaaaaatacaaaaattagccgggcatgstggcgctcacctgtaatcccagctactcgggaggctgaggcaggagagaatcgcttgaaccggggaggtggaggctgcagtgagccgagatcgcaccact

SEQ ID NO: 47736 - DNA, 201 bp, Homo sapiens
atcccagctactcgggaggctgaggcaggagagaatcgcttgaaccggggaggtggaggctgcagtgagccgagatcgcaccactgcactccagcctgggygatggagcaagactccatctcaaaaaaaaaaaagtcagtttaggctgggcgcagtggctcacacctgtaatcccagcactttaggaggctgaggggggtg

SEQ ID NO: 47737 - DNA, 201 bp, Homo sapiens
gattggtgtatttacaatccctgagctagacataaaggttctccaaggccccaccagactcaggagcccagctggcttcacccagtggatcccgcaccggygctgcaggtggagctgcctgccagtcccgcgccctgcgcctgcactcctcagcctttgggtggtcgatgggactgggcgctgtggagcagggggtggtgc

SEQ ID NO: 47738 - DNA, 201 bp, Homo sapiens
ccaaccactaatttagtagctaaaacaacagtaacttaccctgctacagatctggaggccagatgtctgaaatgagtcttagggggctaaaatcaaggcaycagcaggactgttttcttggggagtctctagggaggattccttccttgccttttccagcttctggcatttctgagctatggccatatcattctcaactct

SEQ ID NO: 47739 - DNA, 201 bp, Homo sapiens
cttttgccatataccgtaacattcacagattccaggaattagaccctgcttatctttgggagctatccttcattctaccagacagaagttacaaattcccrcatctagaaggcacagataggtaaccttaaagagggaagcaggatgaacgtaaggcattagggagtggtggggtctacagtgaacctgtaagcacatgcc

SEQ ID NO: 47740 - DNA, 201 bp, Homo sapiens
ggaagacatggagggtctgggaggagaactggttattttttttttggagtgaacagatttcgaattaacatctagttggtgccatatcctatcagtgtgayttataaattctctcatttgatccttgcagggattttataagattagcattattatcctcacttacatatgagtaaaatgaagttcagatagtttgagtca

SEQ ID NO: 47741 - DNA, 201 bp, Homo sapiens
ctctctctctctctgatgttatcatcctaattattggaagacatggagggtctgggaggagaactggttattttttttttggagtgaacagatttcgaatkaacatctagttggtgccatatcctatcagtgtgacttataaattctctcatttgatccttgcagggattttataagattagcattattatcctcacttac

SEQ ID NO: 47742 - DNA, 201 bp, Homo sapiens
tttatattcccacctaaattttagcttctttcttaagtgaattttttttccctgaagtcttgtacatgggatccattctgaaatggattattgaccaggcrtgaggccactctagtgttccaagctaagaagctttaagaggaaaagtctcctgtgtctgttgcacatggtcagaagccagtagaatgatctcggaatcaa

SEQ ID NO: 47743 - DNA, 201 bp, Homo sapiens
aacaataaatgtttatttctcacagttctggaggctaaagtccaacatcagggtactagcatggtcaggttttggtgagggctctttcctggcttgcagayggcccccttcttgctgtattctcacaaggagaatacagttcaagaccagcctggtcaacatagcaagaccccatctctacaataataataaattaataag

SEQ ID NO: 47744 - DNA, 201 bp, Homo sapiens
atttgcttgaactgtctgccaggctgactcagaggtgcaggtgacagcacactgtaatcatgtttacttatgtacgttgatttgcaatatgttaactttgygccttgatctcatttcttctctgctttcccccttctctacccctggtttaattttgagtcaagtcaatgctgctgctgctaggagttacgggcagtggct

SEQ ID NO: 47745 - DNA, 201 bp, Homo sapiens
ggagctcaagatgccctggaatgtcaccccaaattttgcatgtaggaatacttttctggggagagagttcatccattcatgaacatttaccagattctccraagggcgtgggttgccaaatgcttaggaacttccgctttcagtgtttagcaggttagcggggaaatattagtcccattatttaagctgagatttgcgagg

SEQ ID NO: 47746 - DNA, 201 bp, Homo sapiens
ttagattaagcagtttcctttttcttcttgcactagcctcatgatgtttttgttttccagcaactttgctgcttaaagtgtgatccaaagacgagcagtayaggcctcacatgggcttgttagaaatacagatcccaggcccagccttacctactgaatctgcggtttaatcaacataaaatccacagcagattcatatgt

SEQ ID NO: 47747 - DNA, 201 bp, Homo sapiens
tctgcttgacatcatttaggttctttagacctcagtttctctccccgcaaaatgcaagtaataaaaaataatgtccctagctcacgagagtctttgcaagstttacagagtggtcagctcgtccatggaacataaatatctattcaaagggaatggaagaaagcattatgcatagacttttacacttggaggaaatggcca

SEQ ID NO: 47748 - DNA, 201 bp, Homo sapiens
agggctatgttgtgtacctagggggtagctaaatccatttgtgcaaaccaagttagcatgaagatatcaattttttaaaaatacaacaaacaggctgggcrtggtggctcatgcctatagtcccagcactttgggaggccgaggcaggtggattacttgaggtcagcagtttgcaaccagcctggccaacatgctgaaatc

SEQ ID NO: 47749 - DNA, 201 bp, Homo sapiens
cggtaagatcctaatgagctctgtaaccctatctttgtagtcctatcaacggagactcaaaggagatatgccataatgttatcaaggaatctctctggtcrtgggactcagggttttcattttcttttttctttctttttttttttttttgagatggagtgttgctctcttacccaggctagagcgcagtggcgcgatctc

SEQ ID NO: 47750 - DNA, 201 bp, Homo sapiens
aggttacaccggagctggaaagaggtaggaatggagattccaatccaggtctctctgagtccagagcccatatgcccttcctatctttgctactcatagcrtagtcattgaaccagcatggtggatatcacttacatgcttggtagaagtgcacagattcacatcctacccccaggtctgctttttaacaagacttatgca

SEQ ID NO: 47751 - DNA, 201 bp, Homo sapiens
acaaagaagtgggctgtgtgcggtggctcctacctgtaatcccagtgctttgggattacactgggtaatcctccaggatcgctcgaggccaggaattccasactagcctggacaacctggtgagaccttgtctttacaaaaaattataaaaagtggctgggcgcggtggctcacgtctgtaatcccagcactttgggaggc

SEQ ID NO: 47752 - DNA, 201 bp, Homo sapiens
tggtggcacccatctgtagtcccaactattttggaggctgaggtaggagaatcacttgagcccgggaggtggaggttgcagtgagcccagattgtgccacygcactccagcctgggcgacagagcaagactctgtctcaaaaaaaaaaattaatacaagttattaaatagctgagcatagttgtgtgaatctgtagtgcca

SEQ ID NO: 47753 - DNA, 201 bp, Homo sapiens
tgagcccagattgtgccaccgcactccagcctgggcgacagagcaagactctgtctcaaaaaaaaaaattaatacaagttattaaatagctgagcatagtkgtgtgaatctgtagtgccagctaactcgggtggctgaactgggagaatcacttgagtccaggagttcaaggctgcagtgagccataatggtgccaccgta

SEQ ID NO: 47754 - DNA, 201 bp, Homo sapiens
  misc_feature (1)...(201): n = A,T,C or G, or insertion/deletion polymorphism (see Tables 1-2)
gccagggatgtgtgatggctgcagtttcaggtgcctgcaatcttatcccgcctactccagcttcatctccaaccctctcctcatgttcctcacattgcacntgtttctgttccttgaacatatgcttttccctgcctcagggcctttgcactggctgttgcctcttattggcgaggtctctcctcaggcttcaagcagctg

SEQ ID NO: 47755 - DNA, 201 bp, Homo sapiens
cctacgggctgagtattccgtatctggaatgcttgggaccagaagtatttcagattttggatttttaaagagtttggactatttgcattatacttaaccgrctgagcatccctaatcctcccatgagtatttcctttgagtgtcaggtcagtgctcaaacagtttcggagtttggagtattttggattttcagatttggga

SEQ ID NO: 47756 - DNA, 201 bp, Homo sapiens
  misc_feature (1)...(201): n = A,T,C or G, or insertion/deletion polymorphism (see Tables 1-2)
gatgtcagtcatcaaaatggttgatgcaaccatcgttcaggaggctcacccagccagggatgtgtgatggctgcagtttcaggtgcctgcaatcttatccngcctactccagcttcatctccaaccctctcctcatgttcctcacattgcacatgtttctgttccttgaacatatgcttttccctgcctcagggcctttgc

SEQ ID NO: 47757 - DNA, 201 bp, Homo sapiens
agaggagagagagagagagagagagagagacagaggagagagagagagagagacagaggagagagagagagagagagacagagagagagagagagagagasagagacagagagagagagaacaggattccttttgagcttctccccgcatggacaactaagccagcattctgatgttggaatgccaaacaggcaccaaata

SEQ ID NO: 47758 - DNA, 201 bp, Homo sapiens
  misc_feature (1)...(201): n = A,T,C or G, or insertion/deletion polymorphism (see Tables 1-2)
agattttggatttttaaagagtttggactatttgcattatacttaaccggctgagcatccctaatcctcccatgagtatttcctttgagtgtcaggtcagngctcaaacagtttcggagtttggagtattttggattttcagatttgggatgcgctgcctatactaactttttaaataatcatcttatttatattttagtt

SEQ ID NO: 47759 - DNA, 201 bp, Homo sapiens
tcaggtgatccacctgcctcggcctcccaaagtgctgggattacaaagtgcgtgggtggcacccaggcagaaatgggatttagatgtcagtcatcaaaatsgttgatgcaaccatcgttcaggaggctcacccagccagggatgtgtgatggctgcagtttcaggtgcctgcaatcttatcccgcctactccagcttcatc

SEQ ID NO: 47760 - DNA, 201 bp, Homo sapiens
tgtagtcctatcaacggagactcaaaggagatatgccataatgttatcaaggaatctctctggtcatgggactcagggttttcattttcttttttctttctttttttttttttttgagatggagtgttgctctcttacccaggctagagcgcagtggcgcgatctcggctcactgcaacctctgcctccctggttcaagag

SEQ ID NO: 47761 - DNA, 201 bp, Homo sapiens
gatctgcctacctcggcttcccgaaatgctgggattacaggcatgagccactgcacctggccttctttttcttcttcttgttctttttttttttttttttatttcaatcctgttccttctgtatttttttatttttattttttaatttttaatctatgttaaaaatctctttttaatctatgttaaaaatccagtagaaag

SEQ ID NO: 47762 - DNA, 201 bp, Homo sapiens
  misc_feature (1)...(201): n = A,T,C or G, or insertion/deletion polymorphism (see Tables 1-2)
tgaggttaagtaacacgcccagagttggtgagtggccaagccaatattcaaactcagatttcctcattctagagccttattctttcagggctgggcagaantggggaatcagcaaagagaatccatcaagatttggccagctttcccatatggctgtcaaagagcaggaggccaggcgtggtggttcacatctgtaattcc

SEQ ID NO: 47763 - DNA, 201 bp, Homo sapiens
tcggcttcccgaaatgctgggattacaggcatgagccactgcacctggccttctttttcttcttcttgttctttttttttttttttttatttcaatcctgytccttctgtatttttttatttttattttttaatttttaatctatgttaaaaatctctttttaatctatgttaaaaatccagtagaaagccaggtgcagtg

SEQ ID NO: 47764 - DNA, 201 bp, Homo sapiens
ctgaggtgggaggatggcttgaggaggaggttgcagtgagctgagattatgccactgcacttcagcctgggtgacagagccagatcctgtctcaaaaaaaraaaaaaagaaaaaaagaaaaaaaaatcaaacagagaaataatgggtggcttaggagagagagaaaaacaggaaagaatgtaaatgactcatggagttgca

SEQ ID NO: 47765 - DNA, 201 bp, Homo sapiens
tcaccctgctggccaggctggtctcgaactcctgacctcaagtgatctgctggcctcggtctcccaaagtgctgggatcacaggcatgagccactgcaccyggcccatcttatatattctgtcctattgacagacctgctattacatgaagtcccaattgttgacttcggaaaacgctgagttgcacgccatacacagagg

SEQ ID NO: 47766 - DNA, 201 bp, Homo sapiens
ggctggaagggacggagatagggaaagctgcaaagactgggtgaggagtttggattgaccctgcaggctgcaatgagccctagtacgtttcttttgtttctttcttctttcttttttgagatggagttttgctctcgttgcccaggctggagtgcaatggcgcgatctcggctcaccgcaacctctgcctcccaggttcaa

SEQ ID NO: 47767 - DNA, 201 bp, Homo sapiens
gtctgggttagagaaggttgtctgtgatgccagggtctagtggaagatggcaaaatggtggggcgggggacaagtggttattgcagcagtccatttcagasagaccccttgcccatccatccccagggagccaccaccagagaggccagtgggctgagagctgcaggtgttcatttccccctgcatgagggaagccctgcc

SEQ ID NO: 47768 - DNA, 201 bp, Homo sapiens
ctggagtgcagtggcacaatctgggctcactgcaacctccgcctcctgggttcaagccattctcttgctggctgggattacaggcacgcgtcaccatgccyggctaatttttgtatttttagtagagacagggtttcaccatgttggccaggctggtcttgaactcctgacctcaggtgatccacccacctcggccttcca

SEQ ID NO: 47769 - DNA, 201 bp, Homo sapiens
gcccagctggtctcaaactcctgacctcaaatgatccgcctgcctcggcctcccaaagtgctgggattacaggtgtgagccactacgcctggcaaaaaaataaaataaaataaaatttatttaattgtggacttttataattgaatttttagcaatggccatgtttaacaactggtttgcaaaatacttgaaatttgagcc

SEQ ID NO: 47770 - DNA, 201 bp, Homo sapiens
gctagatacagagtgccgattggtgtatttacaatccctgagctagacataaaggttctccaaggccccaccagactcaggagcccagctggcttcacccrgtggatcccgcaccggcgctgcaggtggagctgcctgccagtcccgcgccctgcgcctgcactcctcagcctttgggtggtcgatgggactgggcgctgt

SEQ ID NO: 47771 - DNA, 201 bp, Homo sapiens
tttttaaaattaaaaaaattttttttctaatagagatggggtcttgctatgttgcccaggttggtctggaactcctggggtcaggtgatcctcctgtctcrgcatcccagagtgttgggattacaggcgtgagccgctgtgcccagccattatgttttattttaatgttagtaacgctttggcttgcatagcacattttta

SEQ ID NO: 47772 - DNA, 201 bp, Homo sapiens
aggcacctgccaccacacccagctaattttttaaaaaatattattggtagagacagggtttcaccatgttgaccaggctggtcttgaactcctgacctcargtgatccacctgcctcggcctcccaaagtgttgggattacaggcgtgagccaccgcacctggtcctaacacatacattttctttataaggcacatcaaag

SEQ ID NO: 47773 - DNA, 201 bp, Homo sapiens
gtcaagttgatataaatatgaatacagaaaagtgaaagagaatgtgtgggagagggggcgggggatccattcacatggatcccattggttttagagataaycagtgttaatatcggtgtgtacctgggtgatgtcataagatgaaagaagggtcttgcacgtgacctgcctccacagacacaagtacaggatggggaaaat

SEQ ID NO: 47774 - DNA, 201 bp, Homo sapiens
ctttggaattggatcttaagaactgattaagtgttttggggcaagataacagggagaatactgctgagagaggaataacatagatgaggcacaggaagtargtgaggtgcttgggacactggcatatagaaagagtctttgacagggaaggaaggtcaggctggaagggacggagatagggaaagctgcaaagactgggtg

SEQ ID NO: 47775 - DNA, 201 bp, Homo sapiens
aggccctgaatacagaagggtcactttcttagtggccaaagagcagttgttgacattgatgtctaattattgaacacgaccagtcattttactgagctgcygtgaggaaacactgaccatagaagatcaagccaaatgagggattgcaaatttcctgattcttttgaattaggattccagatgggggcctcatttctacag

SEQ ID NO: 47776 - DNA, 201 bp, Homo sapiens
gaggcagggttttgccatcttggcccagctggtctcaaactcctgacctcaaatgatccgcctgcctcggcctcccaaagtgctgggattacaggtgtgakccactacgcctggcaaaaaaataaaataaaataaaatttatttaattgtggacttttataattgaatttttagcaatggccatgtttaacaactggtttg

SEQ ID NO: 47777 - DNA, 201 bp, Homo sapiens
aacttcatccctccatccatctaaccattaatttatttcatccattcaaaaaatatttagtgtacaactgtacaaggtttttaatgtacattgtctccagttcttacaagagtgagagggtggcagtcatagctccatttacagatgaagaaaaagagaggctaggccgggcgcggtggctcacgcctgtaatcccagcac

SEQ ID NO: 47778 - DNA, 201 bp, Homo sapiens
tagccgggcgtggtggcgggcgcctgtagtcccagctactcgggaggctgaggcaggagaatggcgtgaacctgggaggcggagcttgcagagacagagcygagatctgcactccagcctgggcgagagtgtgagactccgtctcaaaaaaaaaaaaaaaaaaaaagaaggagagaggctcagagagggtaagtaatttgc

SEQ ID NO: 47779 - DNA, 201 bp, Homo sapiens
ctgtgtattagtccacagactaatacacacaatcgcaccattcttgaattagagggaaccaaaaaggtctatctgtctgtctgtctgccagttctatctawctgtcatctatctatctatctatcaattgatcgatcgatcgatcgaaacaccaatactccaagagataaaataaactcacattgctataaagaactacct

SEQ ID NO: 47780 - DNA, 201 bp, Homo sapiens
aatgagaattcactcaccatcatgagaacagcaaagggaaaatccgctctcatgacccagtcgccttccaccaggcccctcctccaacactggggattacrattcgtcatgagatttgggtggggacacagagccaaaccgtatcaggctgttttccctgctgtcaaactcaatcctgacctatgaccctcagctgtctcc

SEQ ID NO: 47781 - DNA, 201 bp, Homo sapiens
tggtctcaaactcctgacctcaaatgatccgcctgcctcggcctcccaaagtgctgggattacaggtgtgagccactacgcctggcaaaaaaataaaataraataaaatttatttaattgtggacttttataattgaatttttagcaatggccatgtttaacaactggtttgcaaaatacttgaaatttgagccagatcta

SEQ ID NO: 47782 - DNA, 201 bp, Homo sapiens
gggagggcaaagtgaaggagcccatgtggggttgctgtgtctgtggagccctctttgaggggcagaggctcaggcttctccgggctcctggtgatgggctstcttcccctttcactgtggtttcccgtgtgagtctggggtcatcctttatgtgtccctgtggacaccgtctcggccccagagagcaaagcctggcttgta

SEQ ID NO: 47783 - DNA, 201 bp, Homo sapiens
catgttttattttcttttgctgtttcgagacaggatcttgctctatcacccaggctggagtgcagtggtatgatcatagctcactgcagcgttgacctccyaggctcaaacaatcctctcacctcagcttccaagtagctaggaccacaggtgtgcaccaccatgcctggttaacttttgtatttttttgtagggaggggt

SEQ ID NO: 47784 - DNA, 201 bp, Homo sapiens
tatgtgtccttgaaattcctgtgatcaacttgagacaaccatttatctcttagaaaggaacaaggctggccaggcacagtggctcacgcctgtaatcccakcactttgggaggccgaggagggcagctcacccgaggtcaggagtttgaggccaacctagccaacgtagcaaaaccccatctctactaaaaatacaaaatt

SEQ ID NO: 47785 - DNA, 201 bp, Homo sapiens
  misc_feature (1)...(201): n = A,T,C or G, or insertion/deletion polymorphism (see Tables 1-2)
aaaatggggaaggcagacgcccctgtcttgggacttgtgtccagggttttatgcatagcaaagagaactgagtgcaagcacagtcccaggcggcagacccngggagccagggtgcaggggggatttgagggcacagttggctatagagcaaggctgtaaggtggtgtaaaccagggtgagctaaggagaaccctggggcca

SEQ ID NO: 47786 - DNA, 201 bp, Homo sapiens
gcgcagattacactcaggacccttcagtaactccctgctgtaatccctaccaaattgcctgccgctgtcaagccgcataacagaccaatttttattccacraggaggagtacctggaaattaggcaagtttgcttccaaatttcatttttaccctctttacaaacacacgctttagtttagtcttggagtttagttttgga

SEQ ID NO: 47787 - DNA, 201 bp, Homo sapiens
cccaaggtattgggattacaggcatgagtcaccgagttctgccaatttttctattagtaagctctgccaccctttctcaggtgctgttccaccccaacagyggggcagctggagagtttggagccctgcagactgtccgcctggagcgttacaaggccttctacattaccggtgagtgaggggccacttagccctgcctcc

SEQ ID NO: 47788 - DNA, 201 bp, Homo sapiens
ttggggcctccaaggccaagtccctggaaaggtttgcacacacagagcagccaccttgctggcccgttgtgtgtcgattcaggctatctgggtattgctcktaattgccattgaatgacattgacattgtgagcctgtgttgtccctgtgcagttctaagatttccctcttctccatcttccctggtcccaaagattctac

SEQ ID NO: 47789 - DNA, 201 bp, Homo sapiens
tgggtggggacacagagccaaaccgtatcaggctgttttccctgctgtcaaactcaatcctgacctatgaccctcagctgtctccaggaggtctccactakcactcccgtcatcgtattagtctggcaggataattgtagttacctagaaactgaagcattgtgcgcctcaattctggtgcagagaaggaaatgctgattt

SEQ ID NO: 47790 - DNA, 201 bp, Homo sapiens
tagctcattgcagcctcaaactcctgagctcaagggattccccccacctcattctcctgagtaccttggactacaggagtgtgccactgcgccccctgcgtttttttttttttttttctgagatagggtcttgctctgttgcccaggctggagtgcagtggcatcattacagctcactgcagcctcaacctcctggattca

SEQ ID NO: 47791 - DNA, 201 bp, Homo sapiens
  misc_feature (1)...(201): n = A,T,C or G, or insertion/deletion polymorphism (see Tables 1-2)
aaccaggcatctggagagctgtgattcatgtgtacttttgacagcttccttcctatattgatataaacaagaaagccataatgggtcttctcaaacaaacnaaaaaaatgcatagacaagttctccaaagtccatctatgtttctgagaatgagccatcccacagttttgcttcctcgtggattttggaagttgcctctgg

SEQ ID NO: 47792 - DNA, 201 bp, Homo sapiens
agctcattgcagcctcaaactcctgagctcaagggattccccccacctcattctcctgagtaccttggactacaggagtgtgccactgcgccccctgcgtttttttttttttttttctgagatagggtcttgctctgttgcccaggctggagtgcagtggcatcattacagctcactgcagcctcaacctcctggattcaa

SEQ ID NO: 47793 - DNA, 201 bp, Homo sapiens
agggtcttgcacgtgacctgcctccacagacacaagtacaggatggggaaaatgcatttattccacagatatttattgccatgtccaactatgggtcaatyattactccagggactggggagatggcagtcatgagcagaccaaacagaaagctctttgtttaggggctaccttaccttcaggaggccagggctttggcag

SEQ ID NO: 47794 - DNA, 201 bp, Homo sapiens
aatgagtgaaagaccctttggacagcaggtccagcaagggccttacatccaacattctcccagctccagagggctcagcacactcttggcagcctgttttktttttttgtttttttttttgagatggagtcttgctctgtcacccaggctggagtgcagtggtgtgatctcagctcactgcaacctccgcctcctgggttc

SEQ ID NO: 47795 - DNA, 201 bp, Homo sapiens
agtgaaagaccctttggacagcaggtccagcaagggccttacatccaacattctcccagctccagagggctcagcacactcttggcagcctgttttttttktttgtttttttttttgagatggagtcttgctctgtcacccaggctggagtgcagtggtgtgatctcagctcactgcaacctccgcctcctgggttcaagc

SEQ ID NO: 47796 - DNA, 201 bp, Homo sapiens
ctggagtgcagcggcacaatcttggctcactgcaacctccacctcctgggttcaagcgattctcctgcctcagcctcccaagtagctggtattacaggcgytcaccaccacgcctagataatttttgtatttttagtagagacagggtttcactgtgttggccaggctggtgtcaaactcctgacctcaggagatctgcct

SEQ ID NO: 47797 - DNA, 201 bp, Homo sapiens
aagttgatataaatatgaatacagaaaagtgaaagagaatgtgtgggagagggggcgggggatccattcacatggatcccattggttttagagataaccartgttaatatcggtgtgtacctgggtgatgtcataagatgaaagaagggtcttgcacgtgacctgcctccacagacacaagtacaggatggggaaaatgca

SEQ ID NO: 47798 - DNA, 201 bp, Homo sapiens
gatgaaagaagggtcttgcacgtgacctgcctccacagacacaagtacaggatggggaaaatgcatttattccacagatatttattgccatgtccaactaygggtcaatcattactccagggactggggagatggcagtcatgagcagaccaaacagaaagctctttgtttaggggctaccttaccttcaggaggccaggg

SEQ ID NO: 47799 - DNA, 201 bp, Homo sapiens
ggctgagtgcagtggctcctgcctgtaatctcagcactttgggaggccgaggcaggtggatcacttgaggtcaggagtttgagaccaacctggccaacacrgcgaaaccccatctctactaaaaatacaaaaattagctgggtgtgttggcatgcacctgtagacccaactacttaggaggctgatgcaggagaatcgctt

SEQ ID NO: 47800 - DNA, 201 bp, Homo sapiens
cttagagaattgaaaactgaggcattgagaagctagatatgtggcagagctgggatttgagcccaggcaacagctggctgcagagcctgggtgctgaaccrctgcaccattctgcctcttgtaggagcagaaatccaggtggaactgaaaggaaaaacaagcaggtagagaagttaagccagcccataggagaggctgtgg

SEQ ID NO: 47801 - DNA, 201 bp, Homo sapiens
aggagggcaccgggtcccagcactggcttactggcctggcagagttccagttaatgtcaccagcactgccttgttaaggtatgagaccaaaactaccttgrgatgttggggcccagagcaagaaaagtcatggaggcatgggtggctagatggaggcatgggtggctagatggaggcatgggtggctagaggcctcaggaa

SEQ ID NO: 47802 - DNA, 201 bp, Homo sapiens
agggctcaggacttcaacatatcttttggggggacgcagcccaacccacagcaagcagccatggctcagaggctgataggtaggttgagccagagcatgaygggttatggtggctgagacttggggctacaaaatggcatgaccaatcagcgtgctaccatgggttagagagagtgcttcgggtgagggacaaccatcatt

SEQ ID NO: 47803 - DNA, 201 bp, Homo sapiens
ttgagtgcctactgttttctattcctcctatttgttgagcacctactgtgtgccaggaactatgcttagtgctggtgccacaaagatcaacaaagccccarccgcaaggaataatagtctagaatagtgtttctttgattttaatatgcagacagtcccctggggatcttgctaacctacagttctgacccaagagggctg

SEQ ID NO: 47804 - DNA, 201 bp, Homo sapiens
gccacaaagatcaacaaagccccagccgcaaggaataatagtctagaatagtgtttctttgattttaatatgcagacagtcccctggggatcttgctaacmtacagttctgacccaagagggctgggttgctgatgggagttttgcatttctaaggttctcctaggtgacgctgatgtggttggtccagggaccaaacttt

SEQ ID NO: 47805 - DNA, 201 bp, Homo sapiens
gctttggggattttcctggaggagagggaggatccctgaggcaccagatgagccaggagagccttctgcagagtcacctcttggttctcctgtttcagcascagcgggaggcccttcctgctctatgtggctctggcccacatgcacgtgcccttacctgtgactcagctaccagcagcgccacggggcagaagcctgtat

SEQ ID NO: 47806 - DNA, 201 bp, Homo sapiens
  misc_feature (1)...(201): n = A,T,C or G, or insertion/deletion polymorphism (see Tables 1-2)
aaagtgtggtccctaaccagcatcattagcaccacctgagaaattgttaacagtacaaattttagggcttcaccccgggccaaaagaatcagaagcactcnggatgggtcccaggaatctgtgtttaaacaagtcctttgggcgataatgcaggttaaaatttgagaactacctgtctagagctacacagtctggtatgtc

SEQ ID NO: 47807 - DNA, 201 bp, Homo sapiens
gagccttctgcagagtcacctcttggttctcctgtttcagcaccagcgggaggcccttcctgctctatgtggctctggcccacatgcacgtgcccttaccygtgactcagctaccagcagcgccacggggcagaagcctgtatggtgcagggctctgggagatggacagtctggtgggccagatcaaggacaaagttgacc

SEQ ID NO: 47808 - DNA, 201 bp, Homo sapiens
atagctcattgcagcctcaaactcctgagctcaagggattccccccacctcattctcctgagtaccttggactacaggagtgtgccactgcgccccctgcrtttttttttttttttttctgagatagggtcttgctctgttgcccaggctggagtgcagtggcatcattacagctcactgcagcctcaacctcctggattc

SEQ ID NO: 47809 - DNA, 201 bp, Homo sapiens
cttcctgctctatgtggctctggcccacatgcacgtgcccttacctgtgactcagctaccagcagcgccacggggcagaagcctgtatggtgcagggctcygggagatggacagtctggtgggccagatcaaggacaaagttgaccacacagtgaaggaaaacacattcctctggtttacaggtaaagtagtaaaagccag

SEQ ID NO: 47810 - DNA, 201 bp, Homo sapiens
ccactgatccaaaatgaccaatgagagaagccagtgacaaaatctccaggaatatccccaagttcaaagaacgccaaagttggaaaagacctcagtcatctttttttttttttttgagacaaagtcttgctctgtcgcccaggctggagtgcagaggtgcgatctcagctcactgcaaactccaccttccaggttcaagcg

SEQ ID NO: 47811 - DNA, 201 bp, Homo sapiens
caccttccaggttcaagcgattctcctgcttcagcctcctgagtagctgggattacagacgtgcaccaccacacccgccaccatgtctggtatttttagtrgagacggggtttcaccatgtcggccaggctggccttgaactcctgacctccagtgatctgccctcctcagcctcccaaagtgctgggattacaggcgtga

SEQ ID NO: 47812 - DNA, 201 bp, Homo sapiens
gacgataccgcagaagctgtgcccctagaaagaggtggtgcggagtaccaggctgtgctgcccgaggtcagaaaggttcttgcagacgtcctccaagacaytgccaacgacaacatctccagcgcagattacactcaggacccttcagtaactccctgctgtaatccctaccaaattgcctgccgctgtcaagccgcataa

SEQ ID NO: 47813 - DNA, 201 bp, Homo sapiens
gggtttcaccatgtcggccaggctggccttgaactcctgacctccagtgatctgccctcctcagcctcccaaagtgctgggattacaggcgtgagccaccrtgcttggctgacctcagcgatctttattccaaccaccttattggacaaatgaggaaactgaggccaaggagaatggaaggcatccccgaggccagccagc

SEQ ID NO: 47814 - DNA, 201 bp, Homo sapiens
gcccgcctttcagcctcccaatcctgtactagttttttgtttttgtttttgttttttgagatggagtctcgctctgtcacccaggctggagtgcagtggcrtgatcttggctcactgcaagctctgcctccctggttcacgccattctcctgcctcagcctcccgagtagctgggactacaggcgcccgccacctcgcccg

SEQ ID NO: 47815 - DNA, 201 bp, Homo sapiens
aggaagatgatgaaaccaggcaggaagcgggcatttctgagacgatgtggggcggtgcacctgcaccctgggcctcctggtgcctttgcagggccccagcrcgggagggcaaagtgaaggagcccatgtggggttgctgtgtctgtggagccctctttgaggggcagaggctcaggcttctccgggctcctggtgatgggc

SEQ ID NO: 47816 - DNA, 201 bp, Homo sapiens
tcacattgctataaagaactacctgagacagggtaatttataaagaaaagaggtttaattgactcacagttctgtaggctgtacaggaagcatggctaggraggcctcaggaaacttacaatcatggcagaaggcgaaggggaagcgtgtatgtcctacatgtttggagcaggaggaagagagtgaaggggaaggcgccac

SEQ ID NO: 47817 - DNA, 201 bp, Homo sapiens
ggctggagtgcagtggcgtgatcttggctcactgcaagctctgcctccctggttcacgccattctcctgcctcagcctcccgagtagctgggactacaggygcccgccacctcgcccgccttatttttttgtatttttagtagagacagggtttcaccgtgttagccaggatggtcttgatctcctgacctcgtgatccac

SEQ ID NO: 47818 - DNA, 201 bp, Homo sapiens
ttgtgattgtttctatttgcttgtctgtctctctaattttgggggcagtagtttgccctgtgacttcacttctccaaaagacctaataagagttgctgaatttttttttttttttttttttttttttgagatggagtctcacattgttgcctgggctggagtgcagtggcacgatctcggctcccgggttcacgtggttct

SEQ ID NO: 47819 - DNA, 201 bp, Homo sapiens
ggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaag

SEQ ID NO: 47820 - DNA, 201 bp, Homo sapiens
tggccaaccagaaaaatcatttggggccagagtgttgtatttatgtgcatatgcattgttgcattaaagcatttagttctgctccgtgagtacgtaggaartgaatactctatggtctgtggtttccacacaggaaccttcaaagagactgttacactgacgtggccctccctctttatgaaaacctcaacattgtggagc

SEQ ID NO: 47821 - DNA, 201 bp, Homo sapiens
tcttattaattaattaatcattattattgtaaagatgggctcttgctatgttgccgaggctgattttgaactcctgggctcaagcagtccttccacttcascttcccaaaatgctgggattataggtatgaggcaccactcccagccaagtcctcttttcacaaatgcacttatctcatcatggaagctgatggaaccctc

SEQ ID NO: 47822 - DNA, 201 bp, Homo sapiens
tcccaaaatgctgggattataggtatgaggcaccactcccagccaagtcctcttttcacaaatgcacttatctcatcatggaagctgatggaaccctcatwaccttatctaaatctaattaccacctaaagggcccatgtccacatatggacacactggggattcgggtttccacatatgaatttcggagggacacaaaca

SEQ ID NO: 47823 - DNA, 201 bp, Homo sapiens
caggtgcacgccactatgcctggctaattttttgtatttttagtagagatggggcttcaccatgttgaccaggctggtcttgaactcctgacctcaggtgrtctgcctgccttggcttcccaaagtgctgagattacaggcatgagccaccgcacccagccccattttccttatagcacttgagctcaacgtttgagctta

SEQ ID NO: 47824 - DNA, 201 bp, Homo sapiens
ttctgagaatgagccatcccacagttttgcttcctcgtggattttggaagttgcctctggtaacgccacataaatagtgggaatatagcagcccaccctcmtggaatttctgtgactgagacgcaagtactgtgactgatctgaagcagcaacttcactcccatcttctgcatgtccgcgtgcatcgtatatcagttgaca

SEQ ID NO: 47825 - DNA, 201 bp, Homo sapiens
atatttagatctctgatccatttccagttaatttttgtatgtggcataagtaagggtccaacttcattgttttacatgttgacatccagttttcccagcaycatttattgaaaacactgtcctttccccattgaatggtcttggcacccttgttaaaaatcatttgatcatacatgtgagggataatttccactgtctatt

SEQ ID NO: 47826 - DNA, 201 bp, Homo sapiens
aattttgagggctatcttttgctttaattccctttgtttatttaattatgtcatatttatttccatcagacccttaactgctttttctatagcaaagccaaaaaaaaaaaaaaaaaaagtcatcggaatcataaagagccaaggaagctgctatcattccaaacatttttgtccttcctcttctggatggctttcacagcc

SEQ ID NO: 47827 - DNA, 201 bp, Homo sapiens
tttgtagtctttcatcccttgccccctcccactttacccccaagtccccaaagtccactgtgtcattcttatgcttttatgtcctcctcataacttagctyccacatatcagtgagaacatacgatgtttggtttttcatttctgagttacttcacttagaataatagcctccagtctcacccaggttgctgcaaatgctg

SEQ ID NO: 47828 - DNA, 201 bp, Homo sapiens
  misc_feature (1)...(201): n = A,T,C or G, or insertion/deletion polymorphism (see Tables 1-2)
tggttcaggtgggggttgacacggcagggtcagggagcgagtcagaagagctggggacaactcagtcttgttatttccgcagcgtgctggacatttttccnactgtggtagccctggcccaggccagcttacctcaaggacggcgctttgatggtgtggacgtctccgaggtgctctttggccggtcacagcctgggcaca

SEQ ID NO: 47829 - DNA, 201 bp, Homo sapiens
  misc_feature (1)...(201): n = A,T,C or G, or insertion/deletion polymorphism (see Tables 1-2)
gccatgcccagctaatttttgtatttttagtagagacagggtttcaccctgctggccaggctggtctcgaactcctgacctcaagtgatctgctggcctcngtctcccaaagtgctgggatcacaggcatgagccactgcacctggcccatcttatatattctgtcctattgacagacctgctattacatgaagtcccaat

SEQ ID NO: 47830 - DNA, 201 bp, Homo sapiens
caagtgatctgctggcctcggtctcccaaagtgctgggatcacaggcatgagccactgcacctggcccatcttatatattctgtcctattgacagacctgstattacatgaagtcccaattgttgacttcggaaaacgctgagttgcacgccatacacagaggctgggattgaagtgagacagcagagaaagccagcaatg

SEQ ID NO: 47831 - DNA, 201 bp, Homo sapiens
catgtcggccaggctggccttgaactcctgacctccagtgatctgccctcctcagcctcccaaagtgctgggattacaggcgtgagccaccatgcttggcygacctcagcgatctttattccaaccaccttattggacaaatgaggaaactgaggccaaggagaatggaaggcatccccgaggccagccagcaatggaggg

SEQ ID NO: 47832 - DNA, 201 bp, Homo sapiens
atccccgaggccagccagcaatggaggggtccacatcctctgaccatcactggctcattctccaagtcacgtgactgctctcacgcacaccttgttatacycgactcctcagccacctggaaaatcctatcttgctctttgaacctagcaattgtcaaggaaaagtctttagcccttgcaacagtctgaatctttctacat

SEQ ID NO: 47833 - DNA, 201 bp, Homo sapiens
tgggggtactgcccaggaggctcccagccttgcacctggcctctaatgataacccccattagactaaatttcttcattcctggctgaaacaacctggcggraccccacccatagaagcattagaaggggattggcaaacaccctgaaaaagattcccccacaaaaggatcaggcaacttaaatcgcatacagataacttta

SEQ ID NO: 47834 - DNA, 201 bp, Homo sapiens
gcagagcaaagcagccctgccttctcccgaagaagaagggcacgagtcagacacccctgctgtctctgagtccacagcctggtccaggaggcctggctctcccagcagccgccttcccttctccatgccagatctgtttcctacccaggacagaaccaacaccttgtttttcccctaactgactgctcctctgtctggaaa

SEQ ID NO: 47835 - DNA, 201 bp, Homo sapiens
ccttgacctccggggctcaagcaatcctcctgcttcagcctccctagtagcttagtagctgggactgcaggtgtgtgccaccatgcctggaacactacaattttttttttttttttttttttttttttttacagagatggagcagaggggtcttgcttgttgcccaggctggtttcgaactcctggcttcaagtgatcttc

SEQ ID NO: 47836 - DNA, 201 bp, Homo sapiens
tctcctcttcctcctcctcttcttccttagcctactcaacgtgaagacaacgaggatgaagccctttatgatgatccacttccacttaatgaatagaaaayatattttgtctttcttccaattttctttttccttccttccttccttctaccttccttcctccttccttccttcctttctctctttctttctttctttact

SEQ ID NO: 47837 - DNA, 201 bp, Homo sapiens
tcgcagctctcgtctttacaacacagggcaactgtcagggttagcgaggcatttgttgtcattccctctctaggtggagccagggcgtgtgatgggagcayggggcctgagctgcagcataagtttcctctgattttcaacctggaagacgataccgcagaagctgtgcccctagaaagaggtggtgcggagtaccaggct

SEQ ID NO: 47838 - DNA, 201 bp, Homo sapiens
cctcttcctcctcctcttcttccttagcctactcaacgtgaagacaacgaggatgaagccctttatgatgatccacttccacttaatgaatagaaaatatrttttgtctttcttccaattttctttttccttccttccttccttctaccttccttcctccttccttccttcctttctctctttctttctttctttactctt

SEQ ID NO: 47839 - DNA, 201 bp, Homo sapiens
cctgtcttggcctcccaaagtggtgggattacaggtttgagctactgtgcctggccaggattttcttactaacattttcttttctctagctcattttattrtaagtctacagtatataatacatgtaacatactaaatgtgtcttaattaaatgtttatgttattggtacggcttcctggtcaacataaggctattagtag

SEQ ID NO: 47840 - DNA, 201 bp, Homo sapiens
gcagtgacgatgactattagctacatttaactttgaaacgtgctgtgttctcttcccgatcttgccccttgccctccttccctgggaatgagtgctctccmcactaaatccccaggagggttttagaagatattgatgtcagagcttcactgcaggtcgattaaatcacagtctctgggaaagagactttggcatgcgtat

SEQ ID NO: 47841 - DNA, 201 bp, Homo sapiens
ccagtgattctaatacatattcaaaatggaaccacctccctaggtttagtgagtgagggtgctggctgtgtagtcagaccggcgttcacatcttggctctrtcattttctttctttcctttttttttttttgacagagtctctgtcgtgcaggctggagtgaagtggctcaattttggctcactgcaacctccgcctcccg

SEQ ID NO: 47842 - DNA, 201 bp, Homo sapiens
gtctggagttgttcgttcctcccggtgggctcgtggtctcgctggcttcaggagtgaagctgcagaccttcatggtgagtgttacagctcataaaagcagygtggacccaaagagtgagcagtagcaagatttattgcagagagcgaaagaacaaagcttccacagtgtggaaagggacctgagcgggttgccactgctgg

SEQ ID NO: 47843 - DNA, 201 bp, Homo sapiens
acaggagcccacggagggggtgggaggctcaggcatggcgggctgcaggtcccgagccctgccccacaggaaggcagctaaggctcggtgagaaatcgagygcagtgctggtgggctggccctgctgagggacctagtacaccctccgcagctgctggcccgggttctaagcccctcattgcccggggcccgcagggccag

SEQ ID NO: 47844 - DNA, 201 bp, Homo sapiens
ggccctgctgagggacctagtacaccctccgcagctgctggcccgggttctaagcccctcattgcccggggcccgcagggccagctggctgctccgagtgyggggcccgccaagcccacgcccacccggaactccagctggcccacaagcgcagcacgcagccccagttcccgctcgcgcctctccctccacacctccctg

SEQ ID NO: 47845 - DNA, 201 bp, Homo sapiens
gggttctaagcccctcattgcccggggcccgcagggccagctggctgctccgagtgcggggcccgccaagcccacgcccacccggaactccagctggcccrcaagcgcagcacgcagccccagttcccgctcgcgcctctccctccacacctccctgcaagccgagggagccggctctcgccttggccagcctagaaaggg

SEQ ID NO: 47846 - DNA, 201 bp, Homo sapiens
tcactggattttggcaaactcgtcaaggtaaggggctcagctggggttggtggatcccattgcaatgctgagcccaggctggggtgtgggattctgcctcygggtgggggacaacttatatctgggccttagggtcatcattgtgaaacagggacacatttgctcaccagccaccagcacccagacaagaaggaacaagta

SEQ ID NO: 47847 - DNA, 201 bp, Homo sapiens
tggctgctccgagtgcggggcccgccaagcccacgcccacccggaactccagctggcccacaagcgcagcacgcagccccagttcccgctcgcgcctctcsctccacacctccctgcaagccgagggagccggctctcgccttggccagcctagaaaggggatcctacagtgcagcggtgggctgaagggctcaagtgcca

SEQ ID NO: 47848 - DNA, 201 bp, Homo sapiens
cctgtggacaccgtctcggccccagagagcaaagcctggcttgtacaccacattgcagcttcttttggcttgtccacagtgcgaggcgaagctaatggagrgctgagtgtgtgatcagctcctcagggggctgtggtacccctatggggattcctctgaaaatctctcttatgtttttctacaggcaaatggcatcttgga

SEQ ID NO: 47849 - DNA, 201 bp, Homo sapiens
aataaggtcacatcacaggttctggattgatatgaaattgaggggaacgctgttcagtctggtgcaattagctgtattacgtatctctctctctctttttyttttttttttttttgagacacagtttcactctgttgcccaggctggagtgcagtggtgcaatcttggctcactgcaacctccgcctccgggttcaagcga

SEQ ID NO: 47850 - DNA, 201 bp, Homo sapiens
ctgccttcaccaccatgggctggctttttctaaaggttttgttggcgggagtgagtttctcaggatttctttatcctcttgtggatttttgcatcagtggraaaacaagaggacagaagccaaactttgtgattattttggccgatgacatggggtggggtgacctgggagcaaactgggcagaaacaaaggacactgcca

SEQ ID NO: 47851 - DNA, 201 bp, Homo sapiens
ttcgttggtacagggtgccttgtatggccagtagtgtacagccaaggggccgctgagcagctttgcaaccttgtaggcgtaatttaacctcgtagagcgtmaatttctccagatctgtaaaatggggatggaggtggtattcccagaattggagggtttaatttatggtacttgtaaagtgcggatcgcagtgactggcat

SEQ ID NO: 47852 - DNA, 201 bp, Homo sapiens
ctttgaaaatcctcaatggaatgtttcatcatggaacactgaagaaacacaatctgtttatttatattcccacctaaattttagcttctttcttaagtgawttttttttccctgaagtcttgtacatgggatccattctgaaatggattattgaccaggcatgaggccactctagtgttccaagctaagaagctttaagag

SEQ ID NO: 47853 - DNA, 201 bp, Homo sapiens
tagtgagtgagggtgctggctgtgtagtcagaccggcgttcacatcttggctctatcattttctttctttcctttttttttttttgacagagtctctgtcrtgcaggctggagtgaagtggctcaattttggctcactgcaacctccgcctcccgggttcaagtgattctcctgcctcagcctcctgagtagctgggatta

SEQ ID NO: 47854 - DNA, 201 bp, Homo sapiens
gctgggattacaggcatgcgccaccacgcctggctaatttttgtatttttagtagagatggggtttcaccatgttaggctggtctcgaactcctgacctcrtgatctgcccacctcagcctcccaaagtgctgggattacaggcgtgagccactgcacccggccggctctatcattttctagctatgtgacttgggggcaa

SEQ ID NO: 47855 - DNA, 201 bp, Homo sapiens
ttacaattgcctgttcacactctagacccttttaagataaatccctttagaatacaaggtctgtggacctgtgatcatttgggtggctggcatatataatygtgtcttcctgttagagccagaacccaggatgtagcctgcactaaccaactagtctgtacaacaaaaagaggggattgctccttaagtggccacactgag

SEQ ID NO: 47856 - DNA, 201 bp, Homo sapiens
attcctcctgcctctggccatgatgcttcttaatgagctgagtgtctgcatagctcactgcagacccatcacatcaggtaaatgtgatgtctcaccattaytcttattgccgccttaaggcagatccaggaggccatctccatggcaaagaacttggctgtgcagcgtctatgtgaaaacaacatcttcccagctatggaa

SEQ ID NO: 47857 - DNA, 201 bp, Homo sapiens
actcttccctcctgggcctcccaaagcactgggattacaggcatgagccatcacacacagccaaggctagtttttggtgttaaattaggctggatttcagycagccagttttacctctatagatttaccttcttgctgtttcccatatgaatccatgttaagcaaatttgggcggagtttcctactgcctggacaggctgt

SEQ ID NO: 47858 - DNA, 201 bp, Homo sapiens
ccatgaggcatagtgccagagtccatggaattttggaattttttttttaagatggaatttccctcttgtcactcaggctggagtgcaatggcacgatctcrgatcactgcaacctccacctcctgggttcaagtgattctcctgcctcagcctcccgggtagctgggattacaggtgcctgccaccatgcctggctaattt

SEQ ID NO: 47859 - DNA, 201 bp, Homo sapiens
  misc_feature (1)...(201): n = A,T,C or G, or insertion/deletion polymorphism (see Tables 1-2)
gccctgccccaccaaggtgctgtgcttggggctggagttgcaactctaagccccatctcatgaaacctacacccggcaaaggaactcaaaactgcatcccnctgtagaaatgtacgatagctggccgggcgcggtggctcatgcctataatcccagcactctgggaggctgaggcaggcggatcacaaggtcaagagatcg

SEQ ID NO: 47860 - DNA, 201 bp, Homo sapiens
ggctggtctcaaacttctgacctcaggtgatccacccacctcagccttccaaagtgttgggattacaggcgtgaggcaccgcacctggccgcattcactaytttgtaatggactaaaagagctaaaataaagccggtggaatgttccacatatcatggcattttgaacaaaaactagatcttttataacacagagacccgc

SEQ ID NO: 47861 - DNA, 201 bp, Homo sapiens
atgctgtctgacacatttgcgataggctccaggacaaggcaaagttccaagactgtggtccatcagcaataaattaaagatgcagacaggaaacagttaaracggcaaataagatacacggtacattctgtgcaaatttaaatgtgttatttgcagggagtgcaagaaacctttcaacgatgaggtccacaaaattcttct

SEQ ID NO: 47862 - DNA, 201 bp, Homo sapiens
caccgcacctggccgcattcactactttgtaatggactaaaagagctaaaataaagccggtggaatgttccacatatcatggcattttgaacaaaaactaratcttttataacacagagacccgcctaatggaaaaggcagtgaatattctcttgtggacacctgtcccacactgtttcctctaagccaatggctgtcacc

SEQ ID NO: 47863 - DNA, 201 bp, Homo sapiens
aggcaaatggaggcagggcgagatcacaggaccgaggcaaaattagaattgctaatgaagtttccgacatgcattgtcattgataacatcttattaggagrcagggtttgagagcagacaaccggtctgaccaaaatttattaggtgggaatttcctcgtcctaataagcctgggagcactacgggcgaccggggattatt

SEQ ID NO: 47864 - DNA, 201 bp, Homo sapiens
acctgtcccacactgtttcctctaagccaatggctgtcaccaagctggtgacaggtagaacgcctcagttcttaggtgggctcacagggattacccttgtraatcattaagacacaaacatccagtgaggactttctgagtgccaggtcttcttctctgtgccttacatgtgtgtttcatgcacacaaccacctgtgagct

SEQ ID NO: 47865 - DNA, 201 bp, Homo sapiens
taattttgagggctatcttttgctttaattccctttgtttatttaattatgtcatatttatttccatcagacccttaactgctttttctatagcaaagccaaaaaaaaaaaaaaaaaaagtcatcggaatcataaagagccaaggaagctgctatcattccaaacatttttgtccttcctcttctggatggctttcacagc

SEQ ID NO: 47866 - DNA, 201 bp, Homo sapiens
gctaaaagagtctctctctaagtatgtaatatacaagaaatacaattcaaagagatgttcctataagtacattttttacacggcatatatttaaaaaggakgccccttttaatataaaattccggttatataccaatatggttaattagcatttacactatagtttgaacgtattttaaatagcatgatgtgtatacaatg

SEQ ID NO: 47867 - DNA, 201 bp, Homo sapiens
ctgccaaccttgataagatggcttcggagggaatgaggtgagtcttgagatgccaggccagcctttctttggatgtcttactcccgttcttgagaggggawggggccgtgcaaagcacttaaagagtcattgatggacccatgctgatttagttaatttattaattaatttggtttgaagccagcatagcatcgtgaagaa

SEQ ID NO: 47868 - DNA, 201 bp, Homo sapiens
aaattgtttatgcttgtgctcaacaaggatctttcacagtcagttgtgctctgatggagcagatgggccttcgttgtgggatttgttgactgacgtggccragtaccttctgccccagtggaaggaggggtgaatgctgtatttgccaaagactctgcctttctttatagccaggagtgctccttccctgtgtctactctc

SEQ ID NO: 47869 - DNA, 201 bp, Homo sapiens
tggaacaatatgtaaagtatgattttattatataaaaataatcacatgtagactcaaaaaaatcttgaaagagtcaataaagggtaacaaaacattagcartaattacctctgggcagcggagggagagttgaaggggtgaatttccccccacaataaactggtattgtttgtttcatataaattaaatgtttaggaggta

SEQ ID NO: 47870 - DNA, 201 bp, Homo sapiens
gtctataaatattaaatgaaaaattacagaaatgaatctaagttttaaattgtgcacattctgaggagtgtggtgaagtctggcaccatcccacccacccygtaacgccctggacgagtccgccctttgtccggtggatccacgctgtatacactacctgcctggtagtcacttagtagccatctcagttatcagattgat

SEQ ID NO: 47871 - DNA, 201 bp, Homo sapiens
tgcacattctgaggagtgtggtgaagtctggcaccatcccacccaccccgtaacgccctggacgagtccgccctttgtccggtggatccacgctgtatacrctacctgcctggtagtcacttagtagccatctcagttatcagattgattgtcgagatatagcagtgcttgtgttccagtcacacttatttttacttacta

SEQ ID NO: 47872 - DNA, 201 bp, Homo sapiens
cagttatcagattgattgtcgagatatagcagtgcttgtgttccagtcacacttatttttacttactaatggccccaacgtgcaagagcagtgatgtgggyaattcgaatatgccaaagagaagccgaaatgtgcttcctttaagtgaaaggtgaagttcttgacttaataaggaaagaaggctgagtgcagtggctcctg

SEQ ID NO: 47873 - DNA, 201 bp, Homo sapiens
cttgaaccctggaggcagaggctgcagtgagccaaggttgcaacactgcacctccagcctgggcaacagaacaagactccatctcaaaaaaaaaaaaaagrgaaagaaaaagaaattatatgctgaggttgttaagatctatggtgagaatgaatcttctatttttttgttttttctttttgttttttttggtagagatgg

SEQ ID NO: 47874 - DNA, 201 bp, Homo sapiens
gaagagctggggacaactcagtcttgttatttccgcagcgtgctggacatttttccaactgtggtagccctggcccaggccagcttacctcaaggacggcrctttgatggtgtggacgtctccgaggtgctctttggccggtcacagcctgggcacagggtaagtggaggaggtacttgcccacatgtaggctctttagga

SEQ ID NO: 47875 - DNA, 201 bp, Homo sapiens
cgtgctggacatttttccaactgtggtagccctggcccaggccagcttacctcaaggacggcgctttgatggtgtggacgtctccgaggtgctctttggcyggtcacagcctgggcacagggtaagtggaggaggtacttgcccacatgtaggctctttaggaggctggtctgctgcctctcacctctgtgcagacagaac

SEQ ID NO: 47876 - DNA, 201 bp, Homo sapiens
gagggttgtcacagacgtcattggagaggtgctccggagtgtttattaccatggctgctaggaataattggggtcatcaggaagtgcttcaaggactgtgstctccttgacgttgtcggtactgcctgtgggagccagctccttcatgtactaacttcctttctcagacgggagagctctgctcttgctctaactggagtt

SEQ ID NO: 47877 - DNA, 201 bp, Homo sapiens
gccacacattgcccgattattcccccagactgagcgcatttgcagaccgaggagcagcagggtgtctgagtttcctcatttgctgccccgtaggtgtctcrgtgcttgaactgcgggctgctgatgttggccagagaggaagatgatgaaaccaggcaggaagcgggcatttctgagacgatgtggggcggtgcacctgca

SEQ ID NO: 47878 - DNA, 201 bp, Homo sapiens
tcatttgcttcctgctacaattatttgtttaccataaatgggatgttgtatgtctgataaaactgatcccatgtatggactgttgtgcattagcctgggcrtctgcttgtttgtgtttgaaaatttgtatttgaaggaaatgctagtctttagaaagttttgtcttggtcttggtgagcaatatgtgctttaactaaaatc

SEQ ID NO: 47879 - DNA, 201 bp, Homo sapiens
tgcacaacctactgactgcggcagtgatagcctgcctgtctccatatcattcaagaactctctgtctgtctctgtctctctctctctgtctctctctctcwctctcacacacacacacacacacacacacacacacacacacacacacacacactaaaccagtcaagaccagggcaagagctgactttgcaaaagaaataa

SEQ ID NO: 47880 - DNA, 201 bp, Homo sapiens
accctcttcctccatactcaaagccaccaacagagggttgagtctccctcatgcttctgatctgtttccttttttcttttttctcatctatgtgacccttrtgtcagcccattgggtgcttggaatgacttgttcagagatactcggggtgatgaagggcccaagaggaaagaggcccatgattcattgagttctgacttc

SEQ ID NO: 47881 - DNA, 201 bp, Homo sapiens
tgacttttaatgactttcatgatgatcttattggatgtatcataagtgacttaatcatttcttcattgtcaaatacatgtttctgatttttttgtatcacagaactgcaatgtaagtaattttttaaaaaggcaagaactgtttacattaaaatcgctttaatgaaaacaaactttaattatgacactgattctctttcac

SEQ ID NO: 47882 - DNA, 201 bp, Homo sapiens
ctcctaatttccttgtgaggctccccatactcctgggctcctgaccctcttcctccatactcaaagccaccaacagagggttgagtctccctcatgcttcygatctgtttccttttttcttttttctcatctatgtgacccttgtgtcagcccattgggtgcttggaatgacttgttcagagatactcggggtgatgaagg

SEQ ID NO: 47883 - DNA, 201 bp, Homo sapiens
ccacttctctttgtctctactccctttgctttaagaaatcataagaactgagtagctgagacaaaaaaaaattaaagatgcctgttcttgaaggcttgaasacacagacagacagacacacacacgcacgcaccctaatgggttttttcccccatggggtgtgcgtgtgtgtgtgtgtgtgtgtgtgtgtgtgttgtgtat

SEQ ID NO: 47884 - DNA, 201 bp, Homo sapiens
acctcgcagctgcacaccctggaggagcggctgcgcctgagccactgcgacggcgagcagagcaagaagctgctcaccaagcaggcgggggagatcaagaygctcaaggaagagtgcaaacgccggaagaagatgatctccacccagcagctgatgatcgaggccaaagccaactattaccaggtgggcagctgtgtgtga

SEQ ID NO: 47885 - DNA, 201 bp, Homo sapiens
atgacttttaatgactttcatgatgatcttattggatgtatcataagtgacttaatcatttcttcattgtcaaatacatgtttctgatttttttgtatcacagaactgcaatgtaagtaattttttaaaaaggcaagaactgtttacattaaaatcgctttaatgaaaacaaactttaattatgacactgattctctttca

SEQ ID NO: 47886 - DNA, 201 bp, Homo sapiens
acgatggagtgtggcggccaacggagatgggtacctcgggcccgcaggcctctgcgcccagatctcagcgggggcgcgcgggccacccccacgttcagctytgaagcccttggcccagatcatgggttaatcgttctaacaggccagaggcagcaaaaataggagggataaagggccaggagctgatgtttccttaactaa

SEQ ID NO: 47887 - DNA, 201 bp, Homo sapiens
cttgaacccagggggttgaggctgcagtgagccatgatcatatcactgcactctagcctgggcaacagaatgagaccctgtctccaaaaaaaaaaaaaaaattagactcgtttaagattagaaagttagattttccttccccttttttcaccctgtacatattctgataggaagaccagcaagcagtagaaacaaaccagt

SEQ ID NO: 47888 - DNA, 201 bp, Homo sapiens
aggtggtgttaggatggcattaaggccaggggatccagcagttactttatgttaccctcgtgcagacattcttctccctgagagtcttgagggaggcatakaggagacagagtgagtcagagatgttttgctgagaatgggagctttggccttaaacttcagtgcagaacactcgtggtgagatatagaagaccctcttct

SEQ ID NO: 47889 - DNA, 201 bp, Homo sapiens
gctggtatatagaaatatagctgctttttgcatgttgaccttgtactgtgcaactttgctgaatttgtttattactttagtcgtttcttatggattctatkttatttttttaaaatagttggtagaattcaccagtaaagccatctggtctgggacttttcctttttaggaggttgttgattactaactctatccctttat

SEQ ID NO: 47890 - DNA, 201 bp, Homo sapiens
ttattttaatttgagagatttgttaccacaacccagaaaggtgaagaatttaaaaaatctaaactatcatgtagttgtttcatttttttaatcagagtacwattaggcacataatacctgcttaggagccatttacctcttgacttatacactgtaaaacagagttatgcatgtaaaagcacaaggtctgtcgacagactg

SEQ ID NO: 47891 - DNA, 201 bp, Homo sapiens
gttatgaatataagtttatgttagttgtgtaatatctttgtcacttgaaatatttgttccttatggtctgtatgtatcttgactagtttgcggcatatttrgctaccatcatgttcggatgcttatgctttaattatggaacctctgagtttttcctttttatgctgtttcagtgaatgccccagccctgcacactttgga

SEQ ID NO: 47892 - DNA, 201 bp, Homo sapiens
aaatgtaggctcttacagctgtaaatttatttctgagcactgatttggctgcatctcatgaatcttggtatgttgtgttttcattttcattaacctcacartatcttccaatttccctagtgagtttttccttaacccattggttgtttaagagcatgttgtttactttccacgtatttgctacttttccagttcccttct

SEQ ID NO: 47893 - DNA, 201 bp, Homo sapiens
ctactgactgcggcagtgatagcctgcctgtctccatatcattcaagaactctctgtctgtctctgtctctctctctctgtctctctctctctctctcacwcacacacacacacacacacacacacacacacacacacacacacactaaaccagtcaagaccagggcaagagctgactttgcaaaagaaataaaaaaagag

SEQ ID NO: 47894 - DNA, 201 bp, Homo sapiens
aggggaacatatctccataaagctgttatgaatataagtttatgttagttgtgtaatatctttgtcacttgaaatatttgttccttatggtctgtatgtaycttgactagtttgcggcatatttagctaccatcatgttcggatgcttatgctttaattatggaacctctgagtttttcctttttatgctgtttcagtgaa

SEQ ID NO: 47895 - DNA, 201 bp, Homo sapiens
catgaatcttggtatgttgtgttttcattttcattaacctcacagtatcttccaatttccctagtgagtttttccttaacccattggttgtttaagagcaygttgtttactttccacgtatttgctacttttccagttcccttctgttactgatttctggcttaattctattgtgatcagagaagaatctttgcatgattt

SEQ ID NO: 47896 - DNA, 201 bp, Homo sapiens
gaagagtgcaaacgccggaagaagatgatctccacccagcagctgatgatcgaggccaaagccaactattaccaggtgggcagctgtgtgtgagcacgatkcataatccagtaaacaactcagttcccatttgataggcctgtcccgtatcaccactctttcttcttaaagatttatattgtatatcagaagacacagtat

SEQ ID NO: 47897 - DNA, 201 bp, Homo sapiens
cctgtcttaggttctcttaggatactaaaaaccctagcccagttgttcatcacctgtgtgctactgatttagttgattactgttttaagcctgttttcttwtctgtagtatgggatgttttaagtctcaatttccttatctgtaatatggaataatgctgcctttttcacgagatagttctacaaattaaatgggaatgta

SEQ ID NO: 47898 - DNA, 201 bp, Homo sapiens
aagagctagggcagagactccaggagcagaatgagctgattataactcagagacagcaggtatgtctggcggcagtgtggcaccgtgcttctttaagcaaygcagtctatctaagaacatgtgtttttactttagagcatttgtaagtggtataaggtgaggaagatggaatatttttccccttgtgattgcttgtaaaag

SEQ ID NO: 47899 - DNA, 201 bp, Homo sapiens
gacacttggatttgttgctctctccttttcagtgccatttttgtgacaaggcctttatgaaccaagcttttctacaaagtcacattcaacgccgccacackgaagaaaattctcattttggtgagtaatgagttctgtttgaaagctcttttcttcctgctccctttttcttttggcaatgagacttggtccagtgcattt

SEQ ID NO: 47900 - DNA, 201 bp, Homo sapiens
acagatttagacactgagtgattaatgacaatatgaaattatggatttttatagacttgacaatgtgcttgtttaaccattgaggccttctcttctgcctstacccaccacttacaggacttcaagaaaatgaatcaagcacattaaaaagcagcttagtaactgtgactgattggagcgacacttcagatgtctaattcc

SEQ ID NO: 47901 - DNA, 201 bp, Homo sapiens
tattggagtgataactgtaacaatacataataagcatgacactttacaggttttcaagatcctgtcacatgtattatctgatacttgcagatatcaaatgrtttgtacaaagaaatttgtgactggccagaattggggcccttcagatcttcttcactaccctggcatgagaccttaggtacttttgagggtttagctcca

SEQ ID NO: 47902 - DNA, 201 bp, Homo sapiens
ggggaaggagtgggaagcaggatgtggtccctgctgtttgtaggctgcagggcagaagcttgcatccaagggtcctgagtgtatcctagagatgcgaccarttcacagttggattttaaagtggcgtcctatacatagctcatgagggttgggagatgaggattcatgaacagatttagacactgagtgattaatgacaat

SEQ ID NO: 47903 - DNA, 201 bp, Homo sapiens
ctttaatgaagtcttctgttcctttgtacataaggactcagatttttaaaggttatgccatcattcttctccaaactgtcttgaacttgacttttttttttaagtggggaataaaaaagggatagggatggaagtgaggagaatatgtcctattgtttttggtttctttgtttttaattataggttgttttaaacaaaata

SEQ ID NO: 47904 - DNA, 201 bp, Homo sapiens
ccagttactctgaattgtattttcctttcttctgttcacatatttggatgttaggaaagaaaaaaaaattcctgatgtctggtccaagcaggaattccccrgtggattggggaatgtctggcttttcctcagcttattgatctctgtggtaaccactggaggcccccagaagacccatagaaatgagaggcctgaggtcta

SEQ ID NO: 47905 - DNA, 201 bp, Homo sapiens
ttctgacttttaatatataattatatgcagttttatcacttcagcttagcaagctgcaatagcaaaacatagaatagtatttttgtgcaggattttgttctctatttaatgtacacaaaagtaatttgactaattttgctttcaataaaaccatctatttatttaatagaaatattttttaatgtgggaattgaactggtg

SEQ ID NO: 47906 - DNA, 201 bp, Homo sapiens
catatcatttactgatgtccaagatataaaatcccatattccttgaagaatctgtgagacatgtcaggaggttcatagaaaacgtcgcgtactttcaaaactagaacttcaggtcatgtagttcacactcatttgaaaaacgactcagtgagggttcctataggaatcatgattgtccaccatcacccagagtggtcttgt

SEQ ID NO: 47907 - DNA, 201 bp, Homo sapiens
ctttcatcaaattcgagaattccttgaacatcaagtcagctgtaaaattgaggagaaagcactactctcttcaggtaagcttgttacccactgcaaatggragcttaatttaacaactttttctttttttcttcttttttcaccacaagatatcattaaacaaattattataattttaaatggttaacaaacttcgccact

SEQ ID NO: 47908 - DNA, 201 bp, Homo sapiens
tcgcttgaacctgggaggttaaagctgcagtgagccatgattacgccactgtactccagcctgggtgacagagggagacacttaaaaaaaaaaaaaaaaaaggaaatatgcagaatgttagttttagaaaccaaagcctgaagtctggatgcagttacactgattaagagtaaggcagcatggtgaacaaaagaacatgtt

SEQ ID NO: 47909 - DNA, 201 bp, Homo sapiens
tctggtccaagcaggaattccccggtggattggggaatgtctggcttttcctcagcttattgatctctgtggtaaccactggaggcccccagaagacccayagaaatgagaggcctgaggtctacaagtcgctgctagaaatattttagcctctccaaagcccagaatgcagccccgacccaagtttgtaaggtaaatacc

SEQ ID NO: 47910 - DNA, 201 bp, Homo sapiens
aaacagttattaaaactgcagtcttcatgtgtaatattgttgtaaactggacatacctcccaaagtcttaaagtataaaaggtgtatataggtataaaagsttgccagactcacaagtagagattttaactttgggtagtgtcttgattatttatgatttttgtggaaagtagtaggtgttgggtaagaatgagggtgacc

SEQ ID NO: 47911 - DNA, 201 bp, Homo sapiens
tgtgccgccaccacaaaacaagggcagcttcgggaagaacacagtgaaaagtgacgcggacgggaccgagggaagcgaaatcgaggacactgatgattctyccaagcccgcaggtgagctgttaccttggaaaactctctggaaactgtatttaggacagttgtcctcacccgtgtgtaccgagcactgggagtctgagct

SEQ ID NO: 47912 - DNA, 201 bp, Homo sapiens
gacttgctcttcacatggctacctccttcccctcagtatgagttttctattctgtgtagcaaatgaccacaaattgagtgggtgaagatggcatgtatttmtcttctcaatgtccgtgggataggagtccaggcagggcttggctgggctcagggactcacaggctgcattgagagtgtcatctgggctgtgttcctgtct

SEQ ID NO: 47913 - DNA, 201 bp, Homo sapiens
  misc_feature (1)...(201): n = A,T,C or G, or insertion/deletion polymorphism (see Tables 1-2)
atggcagttaaatttcaacttgcatttctgaggggacattcaagtcatagcaaatagtaactatatcataggcttgttatgaggattaaatgggataatanacctattaagccctcattaagtttgccattattattgatattaagctcttagtaggccaggcacagttgctcacatttgtaatgcccgcattttgggagg

SEQ ID NO: 47914 - DNA, 201 bp, Homo sapiens
aataaaaaagggatagggatggaagtgaggagaatatgtcctattgtttttggtttctttgtttttaattataggttgttttaaacaaaatacacttttgmtaagacttttgttatcctttttcattttggtaaatattttgaaggggataatgattttcacatcttgaaattttatatgtacttagcttctagtaactaa

SEQ ID NO: 47915 - DNA, 201 bp, Homo sapiens
cccttctgtctttttcctcggttctggctgctttcctgcctgtcctgcagctcccagttttcgggacctgtcttttactcattctttagtattcagccagsggggcaggtaccgctttcagaaagttctcctgagcctctaggctatagcatttctgtagtccctaagtaggatctgatgacatacacattatatgtggat

SEQ ID NO: 47916 - DNA, 201 bp, Homo sapiens
ggaagcgaaatcgaggacactgatgattcttccaagcccgcaggtgagctgttaccttggaaaactctctggaaactgtatttaggacagttgtcctcacycgtgtgtaccgagcactgggagtctgagctgggagggtgtgcaaggaacagatgcagcggatcccaaaggcacccacggaaaatgggcagggtttagcac

SEQ ID NO: 47917 - DNA, 201 bp, Homo sapiens
tgtggtaaccactggaggcccccagaagacccatagaaatgagaggcctgaggtctacaagtcgctgctagaaatattttagcctctccaaagcccagaaygcagccccgacccaagtttgtaaggtaaataccatggccctgtaaaacttgttggtaaagctgatggctaaaatccccctccatctgtttctaccttcag

SEQ ID NO: 47918 - DNA, 201 bp, Homo sapiens
aaaatcaccagttccatagaaatgtatgtgaaattatattattaacttatgcaatttaaaaatatttttctgttgtttttttagaattaagaaaaatgtcwtggaagatccttttcccagaaagtcttcaactattacgtgagtattgacagggatgggagggtcatttaaaaaattattttcactgaacattcctttcat

SEQ ID NO: 47919 - DNA, 201 bp, Homo sapiens
atagagtactaaaaagtgtggaatcagaaagacataagcaagaaagagaaatacctaactttcatcaaattcgagaattccttgaacatcaagtcagctgkaaaattgaggagaaagcactactctcttcaggtaagcttgttacccactgcaaatgggagcttaatttaacaactttttctttttttcttcttttttcac

SEQ ID NO: 47920 - DNA, 201 bp, Homo sapiens
acttgggagccgaagtgagggtggaggccaagctcctctgtctgcattagagaagaagcccaaacattttcccagtggttctaacagccaggacgccagargtgtttctgtggatggagctctatcattgtatttctgggcacagctcatctgtgttgactggtcctccagtccagggcattttgtcaaattacttttatt

SEQ ID NO: 47921 - DNA, 201 bp, Homo sapiens
tgtcacccaggccatcatggctcactgcaaccttaaccttctaggctcaaacagccctcccacctcagcctccccagtaactgaggcagtcctcccacttyggcctcccagagtgctgggattacaggcatgggccaccgctcgtggcccccaaattgtttgtattcttttaattttttttttttttttggccaggcgcag

SEQ ID NO: 47922 - DNA, 201 bp, Homo sapiens
aaaaaggtaacaaagggcttgatcaggtttacctgcacagattatatttatatgccaaaatctaggcctggaaaatatgagccagtggtttttattccackacatcaaaattaggaaagacatttagatttggattttactttcaacccacatagagtatcctgttatcctattcccctaatattctgttctgttttcccc

SEQ ID NO: 47923 - DNA, 201 bp, Homo sapiens
tccagatcagtgcagtgtttctcaaatggataccctttcaactggagaagtacccaaaatgatacaacttccttccaaaaacagacaactgattagacaaraagctgtttctactgataggacatctgttccaaagtgagtatttcagccctcagatttattttatcagtgtttgtcttagctcaggctgctttaacaaaa

SEQ ID NO: 47924 - DNA, 201 bp, Homo sapiens
aaagtccaagatcaggatgccagtatagtcaggttccggtgaaggctgtctgccttgcagacgactgccttcttgccatgcctccagatggtggagatacmtctgaaggagatacatcgcttcctcttcttataaggcaccaatcccatcatgggggcccccatccacatgacctcatctaaacttaatcacctcccaaag

SEQ ID NO: 47925 - DNA, 201 bp, Homo sapiens
aaacattttagtgattgcaaaacagttattaaaactgcagtcttcatgtgtaatattgttgtaaactggacatacctcccaaagtcttaaagtataaaagktgtatataggtataaaaggttgccagactcacaagtagagattttaactttgggtagtgtcttgattatttatgatttttgtggaaagtagtaggtgttg

SEQ ID NO: 47926 - DNA, 201 bp, Homo sapiens
catagatggagaaaggctgattgtagggttcagaagagcagggttaccagagttgtctggaggtctaagcaccatctgctgtagggaggacactagtccasgtttccaccctgcacccagggagcttcccccgtggcaatgactatgtagttaggacgatggcgttcacctcccagcatattttatctatggcagctaaga

SEQ ID NO: 47927 - DNA, 201 bp, Homo sapiens
gtcttttactcattctttagtattcagccaggggggcaggtaccgctttcagaaagttctcctgagcctctaggctatagcatttctgtagtccctaagtrggatctgatgacatacacattatatgtggattctccatggctgtgtctactcgcctcccgtgcagagcagggcctgtctttttatcttcttttagcctgc

SEQ ID NO: 47928 - DNA, 201 bp, Homo sapiens
tactaggtggtagataaattcccttccaactcagaaattcaaggatttttaaaaatcatttgcttcctgctacaattatttgtttaccataaatgggatgktgtatgtctgataaaactgatcccatgtatggactgttgtgcattagcctgggcatctgcttgtttgtgtttgaaaatttgtatttgaaggaaatgctag

SEQ ID NO: 47929 - DNA, 201 bp, Homo sapiens
cggaacctcctctttccagctatgatgactttctgctaatttctagaacattctggccttttcctcttttatacctggttttcattgttggcaagcccttygacttgctcttcacatggctacctccttcccctcagtatgagttttctattctgtgtagcaaatgaccacaaattgagtgggtgaagatggcatgtattt

SEQ ID NO: 47930 - DNA, 201 bp, Homo sapiens
cattgagtccataacagtgtttggtccaactgagaatcacacttgtaattcctaccagtctctaactgacgctgggtgacttttgttgctgctcttcctcrttagtgtatgtcaaaagcaaaaatcaccagttccatagaaatgtatgtgaaattatattattaacttatgcaatttaaaaatatttttctgttgtttttt

SEQ ID NO: 47931 - DNA, 201 bp, Homo sapiens
gtgcctccaaataaggtcacattctaagcaatggggtttagaaattcaacatgtgaatttagagggacacaagtcaacccaggacactgggtgactatgaraatggctgttctaatacactgtgctgcctcttggagctggagtaatactaaaggaagacaagatcttagcctgtcactgcaaatatttgctgacgagaag

SEQ ID NO: 47932 - DNA, 201 bp, Homo sapiens
ttttgctttcaataaaaccatctatttatttaatagaaatattttttaatgtgggaattgaactggtgtttagaaaacatcttaaacaaaaaggcattttsttcaagatctcctgcaaatccaagtagtatgggtattaagaatcctgtctgctgagatgggtgaggcagcagcagaagggagagtctctcgggtggcctg

SEQ ID NO: 47933 - DNA, 201 bp, Homo sapiens
acagccaatgttacatacattgactaggttgctggctaagctgtaagaacctatttatatatacctaagcctgtctgtctgtctgtctgtctgtctatctrtctatctatctatctatctatctatctatctatctatctatctatcatctatctatctatctctatcatctctctctctctctatcatttgtctatctga

SEQ ID NO: 47934 - DNA, 201 bp, Homo sapiens
ttctagatcagggagcaagtaagtgacagaatcaaactttgaaactatttatgtctttagcactttttatgcctggttgcagggaataaaggccaattaayttggacatatggtttatttgaaaccatatgaagtgcgtgttttatttcctggatgtttttgcatgggtttatttctagttaacaatatcttgaaagtgct

SEQ ID NO: 47935 - DNA, 201 bp, Homo sapiens
ccatacagccaatgttacatacattgactaggttgctggctaagctgtaagaacctatttatatatacctaagcctgtctgtctgtctgtctgtctgtctrtctatctatctatctatctatctatctatctatctatctatctatctatcatctatctatctatctctatcatctctctctctctctatcatttgtctat

SEQ ID NO: 47936 - DNA, 201 bp, Homo sapiens
gttgcttgagcccaggaggcaaaggttgtagtgagctgagatcatgccactgcactccaccctgggcgacgggagtaaaactgtgttttttaaaaaaaaawaaaaaagtagctgaggtttgtggccagtattttttagggtaagattagaattaaaagtctgtcttgataaaagaaagaagcggtaaactaatagaccata

SEQ ID NO: 47937 - DNA, 201 bp, Homo sapiens
gcagtggactgggtatgtctcatgggctatagtttgccaaaacttgatctagattatacaagttgcaaatgggtacaaaggcagtatttccagagtttgttagcaatttacaaataggaattgaacactttcactagaagccattgtgaagataaaaaatgcatacctatagaagtagctgatggccgggtatggtggctc

SEQ ID NO: 47938 - DNA, 201 bp, Homo sapiens
acctactgactgcggcagtgatagcctgcctgtctccatatcattcaagaactctctgtctgtctctgtctctctctctctgtctctctctctctctctcwcacacacacacacacacacacacacacacacacacacacacacacactaaaccagtcaagaccagggcaagagctgactttgcaaaagaaataaaaaaag

SEQ ID NO: 47939 - DNA, 201 bp, Homo sapiens
caacctactgactgcggcagtgatagcctgcctgtctccatatcattcaagaactctctgtctgtctctgtctctctctctctgtctctctctctctctcwcacacacacacacacacacacacacacacacacacacacacacacacactaaaccagtcaagaccagggcaagagctgactttgcaaaagaaataaaaaa

SEQ ID NO: 47940 - DNA, 201 bp, Homo sapiens
cacaacctactgactgcggcagtgatagcctgcctgtctccatatcattcaagaactctctgtctgtctctgtctctctctctctgtctctctctctctcwctcacacacacacacacacacacacacacacacacacacacacacacacactaaaccagtcaagaccagggcaagagctgactttgcaaaagaaataaaa

SEQ ID NO: 47941 - DNA, 201 bp, Homo sapiens
tgttacttgttggggcacccttaccctctacacacaactggagccctgtaaggatggattgaaatgttggcacagttaatgctgatatatgcccatgaaaygaaacctcccaggataactggccaacttaacatcttattctttcaggatatacgtggcatttcaagtgatcagttgcatagagtactaaaaagtgtggaa

SEQ ID NO: 47942 - DNA, 201 bp, Homo sapiens
gcctccctccctggaattcttctagcctttgtagactcattgggtccttatgacacacagcctcgtcggtcagccagtcataaacatatgcatgccttatrtgcccaactgaacacatggcccctttggggacagtgtgttacttgttggggcacccttaccctctacacacaactggagccctgtaaggatggattgaaa

SEQ ID NO: 47943 - DNA, 201 bp, Homo sapiens
ggtaataacttctgcctctatgcttttaaagaccacatgccctatgtccctggataatttagtgaaaaggttaatttactaacaacattatctgtccattwtcccatgtgtgtgtccctatctaatttcaaatgtatcactagaagactgtatttctttgcagattaaagactttacctgtaatccattaaacagtatcag

SEQ ID NO: 47944 - DNA, 201 bp, Homo sapiens
tacatgaatatattgtgtgatggtgaggtttgggtaataacttctgcctctatgcttttaaagaccacatgccctatgtccctggataatttagtgaaaakgttaatttactaacaacattatctgtccattatcccatgtgtgtgtccctatctaatttcaaatgtatcactagaagactgtatttctttgcagattaaa

SEQ ID NO: 47945 - DNA, 201 bp, Homo sapiens
ttctgggcagacttggtgaccttgccagctccagcagccttcttgtccactgcttcagttttcttgtatgcatttctgtaagtgtagaacctcatatatayatagttttacaacattcgaattatgttttgtaggtttgtacacttttcactttatatatcatagacctttcctaagttttaaagtattcttcaaaatcat

SEQ ID NO: 47946 - DNA, 201 bp, Homo sapiens
gtttctccactgaagattttctcttttttcctcctttccctgctgtcctttctgaaatgaagtcactatgagcagcctacactgaggagaggagacgtgcrctcccccatacttttgtttttgaagttaatgtgttaccttctgtggttttctgagggtttttgccatgagtaacattgggaataatatgaaaagaaaagg

SEQ ID NO: 47947 - DNA, 201 bp, Homo sapiens
tggcccaagtttgcattttgaatgccccccaagtcctctgcttgtattagcactgatggggtcctcagaagagttcagcgggcacctaaaggatggtgacyacagagatttcagtatggtggtgcctgcagaggaagctgttgcttgccttctgtgattgagacaggcacctctaagaaaagcccagagtgccactgggtc

SEQ ID NO: 47948 - DNA, 201 bp, Homo sapiens
tttttatgcctggttgcagggaataaaggccaattaacttggacatatggtttatttgaaaccatatgaagtgcgtgttttatttcctggatgtttttgcwtgggtttatttctagttaacaatatcttgaaagtgctaaatatatttgatattacaactttgcttccagttactctgaattgtattttcctttcttctgt

SEQ ID NO: 47949 - DNA, 201 bp, Homo sapiens
agagggaaacacatcagaacctggcagtttatcctgactctagagaaataagtcataggagtatccctgttataaaataataaatatgtgtgagattattwcatgaaagttttattaaaagtttccttgtgaccttattttgatcacaagtaaataaaatacagtgtgactttttaaaatctgaaattagttatcctcctt

SEQ ID NO: 47950 - DNA, 201 bp, Homo sapiens
aatttgctttaatattgaatatataagaaaagtatctagcaatcattctgtattcatattattttatgtcaggtctaaaatctctctgttgcgtccctttrtaaagcattgctggccatttctcttttgtacttcaacagtgtattttagtttcttttacttccccacccctccactttgttattgttagctttctgtatg

SEQ ID NO: 47951 - DNA, 201 bp, Homo sapiens
cagggctgggtgaacgcgtggagatggctgtggggtcccggaccggaccgggttccgagtgcgaagacccaggctggggaacagagcgggacccctccccmcggccccgcacccgaggtctcactcagaaaaccccaacaacagtgaggactccgcctcttcgctcctcctctcctgtgcttagtgcgggttcgcctgggc

SEQ ID NO: 47952 - DNA, 201 bp, Homo sapiens
agggtggggcgggaaggagggggaaagagctaccagcaaaaaagtggttaacacaacagagttgctgcaggctctggtttgaggcaggttatgaaaccacrtcagggcccagcactaagcagccacctgccagctatggcagcagaagttttcggctcaactcctgtagacctagtcgacctctgccagcctcttctctct

SEQ ID NO: 47953 - DNA, 201 bp, Homo sapiens; identical to SEQ ID NO: 34835

SEQ ID NO: 47954 - DNA, 201 bp, Homo sapiens; identical to SEQ ID NO: 34846
  misc_feature (1)...(201): n = A,T,C or G, or insertion/deletion polymorphism (see Tables 1-2)

SEQ ID NO: 47955 - DNA, 201 bp, Homo sapiens
aagtgaggccgggagcctgagcctgggctggagccttctcccctccccagttggactaggggcagtgttaattttgaaaaggtgtgggtccctgtgtcctyttccaggggtccaagggaacaggagaggtcactgggcctgttttctccctcctgaccctgcatctcccaccccgtgtatcatagggaactttcaccttaa

SEQ ID NO: 47956 - DNA, 201 bp, Homo sapiens
aagagctaccagcaaaaaagtggttaacacaacagagttgctgcaggctctggtttgaggcaggttatgaaaccacatcagggcccagcactaagcagccrcctgccagctatggcagcagaagttttcggctcaactcctgtagacctagtcgacctctgccagcctcttctctctgtttctccccatctagggtagggg

SEQ ID NO: 47957 - DNA, 201 bp, Homo sapiens
aggaggtgagtggatgcagtgacctcaaaatagttcatccactgctgcctgtacccacaggcctcacttcctttccctcctgatgggaagagcttaagagyagatgtcccacattaggccttcagtgagacacagtccagcaggggttgtgctgagtgagaattctctccctggggctttgtcggcagagggtcctcatgg

SEQ ID NO: 47958 - DNA, 201 bp, Homo sapiens
  misc_feature (1)...(201): n = A,T,C or G, or insertion/deletion polymorphism (see Tables 1-2)
cctgtacccacaggcctcacttcctttccctcctgatgggaagagcttaagagcagatgtcccacattaggccttcagtgagacacagtccagcaggggtngtgctgagtgagaattctctccctggggctttgtcggcagagggtcctcatgggagtgccatagggggtgaggctgggggatgggccttgacttctctgc

SEQ ID NO: 47959 - DNA, 201 bp, Homo sapiens
gggcagtgttaattttgaaaaggtgtgggtccctgtgtcctcttccaggggtccaagggaacaggagaggtcactgggcctgttttctccctcctgacccygcatctcccaccccgtgtatcatagggaactttcaccttaaaatctttctaagcaaagtgtgaataggatttttactccctttgtacagtattctgagaa

SEQ ID NO: 47960 - DNA, 201 bp, Homo sapiens; identical to SEQ ID NO: 34849

SEQ ID NO: 47961 - DNA, 201 bp, Homo sapiens
gtgagtgcctgggctacaggaagacaccagcaggcagggcaaggcctggaggaccccagggcccagccatgcttattaaccctgccgtggctcctggtgtrgggatgaacagaggaagttggaatattcctgggtcttacactggactcaggctttgggcctccctggccccatctttcctccattggagcttccttcctg

SEQ ID NO: 47962 - DNA, 201 bp, Homo sapiens
tttattgatctcttctttttcaggggtctctggtggtttcctgctctcagggcacctagtgtttaggcttcaggaagaagcttctgagggtgttggctaggacctaggtctaggcttttcctaggctcatcaagttttgttggctgccctgtgaaagccagaaaggcgtatggggtcctgtgatctgggattccccaaggc

SEQ ID NO: 47963 - DNA, 201 bp, Homo sapiens; identical to SEQ ID NO: 34851

SEQ ID NO: 47964 - DNA, 201 bp, Homo sapiens; identical to SEQ ID NO: 34852

SEQ ID NO: 47965 - DNA, 201 bp, Homo sapiens; identical to SEQ ID NO: 22660

SEQ ID NO: 47966 - DNA, 201 bp, Homo sapiens; identical to SEQ ID NO: 22661

SEQ ID NO: 47967 - DNA, 201 bp, Homo sapiens
ttcagccttattcacaggtgaggtagtgatcactctgggatgctgagagtatccccatagtgacacagctaggaggggcagcacctacctgtcctgtcccyagtaaccaggtttatctcataaacagatggattcttgtattgaagcctttggtaccaccaaacagaagcgagctctgaacaccaggagaatgaacagagt

SEQ ID NO: 47968 - DNA, 201 bp, Homo sapiens
taaagctgcatattaaatattcacagtatacactcatgttaggctcagggaagtcctatagtaaagaaatctattattcttagatagacaaatgaatattwaacactattactatttgtaggcctcccaattgacttttctttctctctgtttttgtgtgttttgatagatgtatcagttgagagtgaactggcgctagag

SEQ ID NO: 47969 - DNA, 201 bp, Homo sapiens
ccactccagcctgggtgacagcaagactctgtctcaaaaaaaaaaaaaagaaagctgtacaaataatgcttttgaataatccattgttatttgtattattycttctttattcaggcactttgtgggaattttgaacaagacctctggccaaatggaagtatatgatgctgaattgttcaacatgcagccactattttcagg

SEQ ID NO: 47970 - DNA, 201 bp, Homo sapiens
gagccctcaaatgcaacactttgtgcaggtaatggcaggggaagggacagtgggaagggtgatggggttgggagtggtggcagcactggcactgctgtttyctgtctgttttaagggtagcaggagccatctagagaggtttactaggtgatccctgtgttcctattagacccagagcccttccctgcacgtgtagacgtt

SEQ ID NO: 47971 - DNA, 201 bp, Homo sapiens
gggttttgagagaaaatgatcaaactcaactttgtgttgtaggtgctctgggacctggagttccccacatcatcaacaccaaactgctgaagcactttacytgcttgacctacaacaatggcaggtcagggggtggttgctgggatttttcttgtgcaggagaaagtaggtgggggttgggagtgaggagcaggggcttgg

SEQ ID NO: 47972 - DNA, 201 bp, Homo sapiens
gtcactttaggtatgtaccaggcctctgctgtcagcctccttccgcgagacattccctcctgtcacagcccctccccagggttctcccacctccctacctyctcttctcagctggccccggatctcctccagttccctttgggtcaggacccgagcttccttgccatccccattctggcactccctcccagtgacagtcta

SEQ ID NO: 47973 - DNA, 201 bp, Homo sapiens
aagattactgcatatgtgatcatacttgccttgcacatacatgacttccaaattgacctgacagtgttacagagggacttgaagctcagtgagaaaaggtragcacaacagaataaagagctccctgcagggtgtctcgatgtcttatttctggtaccactggaaagcatgaggcaccaccaagggaactgaggatgttta

SEQ ID NO: 47974 - DNA, 201 bp, Homo sapiens
cttctcagctggccccggatctcctccagttccctttgggtcaggacccgagcttccttgccatccccattctggcactccctcccagtgacagtctagtsccaccgtacattgtgtggtacattgtgtggccttctgctctcatctcattcttgggctgcactcttacagtccagttctccaacgggaagctacagagtc

SEQ ID NO: 47975 - DNA, 201 bp, Homo sapiens
tgggattctgtctttatggcctggagcatgaatgtgctgctaccttttgccaaacctccctgaacagtcatgttgaggggtctctccagttcttctgtttrtgtcttccttaggatgatggagatagccaaagccatgaggctgaagatctccaaaagaagggtgtctgtggccgccggcagtgaagaagatcacaaactg

SEQ ID NO: 47976 - DNA, 201 bp, Homo sapiens
aatttttgtatttttagtagagacggggtttcaccatgttggtcaggctggtctcgaactcctcacctcatgatctgcctgccttggtctcctaaagtgcyggggttacaagtgtgagccactatgcccagccagttgttttttgttttgttttgttttgttttgttttgttttgtttttttgagatggagtctcactcta

SEQ ID NO: 47977 - DNA, 201 bp, Homo sapiens
gatcacctgaggtcaggagttcgagaccagcctggacaacatggtgaaacccatctttattaaaaatgcaaaaattagccggggatggtggcgtgcgcctstaatcccagctactcagcaggctgagacaggagaattgcttgaacccgggaggtggaggttgcagtgagccgagatcatgccactccactccagcctggg

SEQ ID NO: 47978 - DNA, 201 bp, Homo sapiens
tgttgcccagggtttcatcagctgttgagtgcgtcggggtgagaggcgcctgctgttctcgttgtaagagggaagtagttcctgacagagcccatcttacsctgacacaggcctccttttcttttccttgttttagccattgcacctttgtcatagaagcgttgaagtctttgccatcagatgtggagagccgagaccgcc

SEQ ID NO: 47979 - DNA, 201 bp, Homo sapiens
agggtcagatcacctgaggtcaggagttcgagaccagcctggacaacatggtgaaacccatctttattaaaaatgcaaaaattagccggggatggtggcgwgcgcctgtaatcccagctactcagcaggctgagacaggagaattgcttgaacccgggaggtggaggttgcagtgagccgagatcatgccactccactcca

SEQ ID NO: 47980 - DNA, 201 bp, Homo sapiens
atctgtgcctgctttcgcactacgatggcagagtcaagtagttgcaacagaggttgtatggcctccaaagcctaaaatatttactgtctagccctttattsatccctgcactgaaccatgttctcctattataaggagtgttgagtgtactggcccttcatcagctgcttttgttcgtttgtttttttttgtttctgagac

SEQ ID NO: 47981 - DNA, 201 bp, Homo sapiens
ggtccctacaaaggtcatctcaccccaagatgacaaactgattgaatctttggtgctgtgtggagcactgtattgagaagggttgtgaggctactttttgsttcagggggaaggagtcagtgatctattagccctgtctgttacgggtgtaagatgggagaattaccattctactattcctgtctgttacgggcataggat

SEQ ID NO: 47982 - DNA, 201 bp, Homo sapiens
atatattggttgtagcctgaaaacattcacgttaaaacaaagtaaacttggggattttcaatgtagaaggtccctacaaaggtcatctcaccccaagatgrcaaactgattgaatctttggtgctgtgtggagcactgtattgagaagggttgtgaggctactttttgcttcagggggaaggagtcagtgatctattagcc

SEQ ID NO: 47983 - DNA, 201 bp, Homo sapiens
tttctttctctctgtttttgtgtgttttgatagatgtatcagttgagagtgaactggcgctagagagtcagaccaaaacttacagagaaaaggtgagtgtratagaattaagatgtgggaccttaagcaagttccttctacacctcgggtttctccatcagtgaaatgagcttgttgaactcaagggtctccctggctgct

SEQ ID NO: 47984 - DNA, 201 bp, Homo sapiens
aatattaaacactattactatttgtaggcctcccaattgacttttctttctctctgtttttgtgtgttttgatagatgtatcagttgagagtgaactggckctagagagtcagaccaaaacttacagagaaaaggtgagtgtgatagaattaagatgtgggaccttaagcaagttccttctacacctcgggtttctccatc

SEQ ID NO: 47985 - DNA, 201 bp, Homo sapiens
ggccttctgttttttaatttctaaaatgaagaggttgggctggatgaccgcttgatttggctaatttattttccaagttctttaactgtatactaaagctrcatattaaatattcacagtatacactcatgttaggctcagggaagtcctatagtaaagaaatctattattcttagatagacaaatgaatattaaacacta

SEQ ID NO: 47986 - DNA, 201 bp, Homo sapiens
tgtctctgccactacctggtgaactgacctggggcaagtaatttcatctgtgggccttctgttttttaatttctaaaatgaagaggttgggctggatgacygcttgatttggctaatttattttccaagttctttaactgtatactaaagctgcatattaaatattcacagtatacactcatgttaggctcagggaagtcc

SEQ ID NO: 47987 - DNA, 201 bp, Homo sapiens
tgcacagactgaaaagaatgttggggaactggaaacaaacagggtgatacatggattgtttctttattgaaaagctctggtcagcgatgctatccacaatsacttgcaagatgactccctctaccttcctccctgctatgatgatgcagccaagcctgaagacgtgtataaatttgaagatcgtatccttcttgcagtaga

SEQ ID NO: 47988 - DNA, 201 bp, Homo sapiens
gctcacgcctgtaatcccagcactttgggaggctgatagggtcagatcacctgaggtcaggagttcgagaccagcctggacaacatggtgaaacccatctytattaaaaatgcaaaaattagccggggatggtggcgtgcgcctgtaatcccagctactcagcaggctgagacaggagaattgcttgaacccgggaggtgg

SEQ ID NO: 47989 - DNA, 201 bp, Homo sapiens
ttttttttccctaatccagtggaagaatttacattgtttctctgctttgtcatcttagaatgctcagggctagagtgagatcttccaaaataataaataaragggtcacactcaaggggcttctgttccttaaatctcagaacttgaatccttagtgatgcccttaaatactgggaaccatggcaggatagggcgatagac

SEQ ID NO: 47990 - DNA, 201 bp, Homo sapiens
ctcaaggggcttctgttccttaaatctcagaacttgaatccttagtgatgcccttaaatactgggaaccatggcaggatagggcgatagacaagaaagaamcattgggagcattgtgaatctgcctgatacctcagaggcattagttccagttttattctctcaaagcagtgcttccatcccttttgagaatctgctaagg

SEQ ID NO: 47991 - DNA, 201 bp, Homo sapiens; identical to SEQ ID NO: 22673

SEQ ID NO: 47992 - DNA, 201 bp, Homo sapiens
taaacattttattctaattgtttccagtatattatttgtctgtaattcttagatgagttctgatgagagaagaaaatggatatgtctgtccaagtctttaytgtcaactgtgagattcattctggtactgctgacatgtcgaggggacttgccaggcccctttttctctctggatctcccattttctcatctgaaaattgg

SEQ ID NO: 47993 - DNA, 201 bp, Homo sapiens
gattgttttcccagcagccctgctgggcaggcggggacagactcacagggccctcaccagctcaaagcgctagcagtgcccaggtagagtgtaggcccagstttctctatctgcctcagagggaaacatggactggcacactgctccactgtgtgtgaggcccaggaaccttggaagggcaaagtcacccacattcctttt

SEQ ID NO: 47994 - DNA, 201 bp, Homo sapiens
catcacagccactggctggtcctattcatttccatttttatgtatgttttgaaaagaaaaggtccggggatggtggctcacacctgaaatcccagcacttkgggaggccgaggcaggaagatcattgagctcaggagtttgaaaccagtctggacaacatagggagaccccatctctaccggaggaaaaaaaaaagagtca

SEQ ID NO: 47995 - DNA, 201 bp, Homo sapiens
gagctcatagggtagttaagcggaaaagtaagtctatgataaacattttattctaattgtttccagtatattatttgtctgtaattcttagatgagttctratgagagaagaaaatggatatgtctgtccaagtctttactgtcaactgtgagattcattctggtactgctgacatgtcgaggggacttgccaggcccctt

SEQ ID NO: 47996 - DNA, 201 bp, Homo sapiens
gcctgcttttaggtctttcaccaagaaagcaaaattattttctggaaagagccaaggacttgttttctaatcctgtctctgccactacctggtgaactgayctggggcaagtaatttcatctgtgggccttctgttttttaatttctaaaatgaagaggttgggctggatgaccgcttgatttggctaatttattttccaa

SEQ ID NO: 47997 - DNA, 201 bp, Homo sapiens
gaggtgtggcctgagggttttgagagaaaatgatcaaactcaactttgtgttgtaggtgctctgggacctggagttccccacatcatcaacaccaaactgstgaagcactttacttgcttgacctacaacaatggcaggtcagggggtggttgctgggatttttcttgtgcaggagaaagtaggtgggggttgggagtgag

SEQ ID NO: 47998 - DNA, 201 bp, Homo sapiens
ataatttttttttttttttgagacccagtctcgctttgtcacccaggctggagtgtagtggtgcaatctgggctcacagaagactctgcctcccgggttcwagcgattttcctgcctcagcctcttgagtagctggggttataggtgtgcgctaccacactcggctaatttttgtatttttagtagagatggggtttcacc

SEQ ID NO: 47999 - DNA, 201 bp, Homo sapiens
agttttattctctcaaagcagtgcttccatcccttttgagaatctgctaaggacctggacctacttctgagaaacatatatgatacacaaatacatatatwtgggattttttttaatatgggattttatacataatttttttttttttttgagacccagtctcgctttgtcacccaggctggagtgtagtggtgcaatctg

SEQ ID NO: 48000 - DNA, 201 bp, Homo sapiens
cacagccactggctggtcctattcatttccatttttatgtatgttttgaaaagaaaaggtccggggatggtggctcacacctgaaatcccagcactttggraggccgaggcaggaagatcattgagctcaggagtttgaaaccagtctggacaacatagggagaccccatctctaccggaggaaaaaaaaaagagtcaggc

SEQ ID NO: 48001 - DNA, 201 bp, Homo sapiens
ggttctttcttaattcttaactgttatagttggggtaaagaggttttagaatttctggtagacaaaggaaattgcttattaagttgtatagtaactttcaygttgaggacaagtctctacactaatttgaggaagatctattttttttccctaatccagtggaagaatttacattgtttctctgctttgtcatcttagaat

SEQ ID NO: 48002 - DNA, 201 bp, Homo sapiens
ccattgttatttgtattatttcttctttattcaggcactttgtgggaattttgaacaagacctctggccaaatggaagtatatgatgctgaattgttcaayatgcagccactattttcaggtaggtcccagtcatgaaagctgacagaaataatgcatagtttgggtttgctggatgagttggcttgagttttagatttat

SEQ ID NO: 48003 - DNA, 201 bp, Homo sapiens
ccgggaggtggaggttgcagtgagccgagatcatgccactccactccagcctgggtgacagcaagactctgtctcaaaaaaaaaaaaaagaaagctgtacraataatgcttttgaataatccattgttatttgtattatttcttctttattcaggcactttgtgggaattttgaacaagacctctggccaaatggaagtat

SEQ ID NO: 48004 - DNA, 201 bp, Homo sapiens
ctccccgtttacttgattttgcctccataaaactgttgtgccataaattgtagtgtaattctaggttcgtacaccccaaaagagttttccattacactacmgcagtgagcccaaatgtgatcaactatcagaatcacctagtagcttttttttttttcccagaaccacctcatatcctcccatcccatcctatcctttcct

SEQ ID NO: 48005 - DNA, 201 bp, Homo sapiens
aagcccagggcctctctctcaagtcttgtggcagaattcccccaagagcttttcataccatttagaagctagcaccatctgaggcttctcttccagaagtygtcttgcttcccctgcagggacaccccatattcccttagagatagtggggctggatcatctgccagagatgaactagttctaatccattgtgagtctgga

SEQ ID NO: 48006 - DNA, 201 bp, Homo sapiens
agggttctcccacctccctacctcctcttctcagctggccccggatctcctccagttccctttgggtcaggacccgagcttccttgccatccccattctgrcactccctcccagtgacagtctagtcccaccgtacattgtgtggtacattgtgtggccttctgctctcatctcattcttgggctgcactcttacagtcca

SEQ ID NO: 48007 - DNA, 201 bp, Homo sapiens
taatcccagcactttgggaggctgatagggtcagatcacctgaggtcaggagttcgagaccagcctggacaacatggtgaaacccatctttattaaaaatrcaaaaattagccggggatggtggcgtgcgcctgtaatcccagctactcagcaggctgagacaggagaattgcttgaacccgggaggtggaggttgcagtg

SEQ ID NO: 48008 - DNA, 201 bp, Homo sapiens
ggaagttgtaggacaacccaatttgagcttagtaagaagagcttcctcacaatcagatggaagggtttgccaggggaaccgctggttccaaggccaggtgkaactgctgtttggcagggattttatgtttgcacttctctgacccaactgggagagctggtggtggaggtgaccttttaggctccatctagccttgtagag

SEQ ID NO: 48009 - DNA, 201 bp, Homo sapiens
gaagatcattgagctcaggagtttgaaaccagtctggacaacatagggagaccccatctctaccggaggaaaaaaaaaagagtcaggcctggtggtgtgcrcctgtaatcccagctactcgggaggctgaggcaggacgattacttgagcttgggaaatcaaggttgcagtgagctatgattgtgtggccacactccatcc

SEQ ID NO: 48010 - DNA, 201 bp, Homo sapiens
tgctgcaagcttctaggaaaacagccaaatcaggcctagccccactcagagttcatactctagagcagggtttctcaacctcaggactattgactttttgrgccaataattctttgctgtgggggcagcatccctagtctctactcattagatgccagtagcaccagagtggatttccctggattgagaacctctgctcta

SEQ ID NO: 48011 - DNA, 201 bp, Homo sapiens
tgatgcttaatacctttcaacattggttgtaaatggagtttcccctctctgcattttaggcagctgaaacagataggctctcctatgtgggaaacaatttygggactggagccctcaaatgcaacactttgtgcaggtaatggcaggggaagggacagtgggaagggtgatggggttgggagtggtggcagcactggcact

SEQ ID NO: 48012 - DNA, 201 bp, Homo sapiens
ttgtgcaggtaatggcaggggaagggacagtgggaagggtgatggggttgggagtggtggcagcactggcactgctgtttcctgtctgttttaagggtagsaggagccatctagagaggtttactaggtgatccctgtgttcctattagacccagagcccttccctgcacgtgtagacgttgctggaaaggaaagataact

SEQ ID NO: 48013 - DNA, 201 bp, Homo sapiens; identical to SEQ ID NO: 22677

SEQ ID NO: 48014 - DNA, 201 bp, Homo sapiens
gggctgggagtcggagaactgagtcaccaagctctgcccctatgtgatctgccctgtgtgatctttggctctctgagcctgtttccctgtctgtgaaatgycactgctatgagatgacctagctagttggatgtttctattttggttggattatattcttgacctgtaactagttctttcccctgcggagtatgaagctct

SEQ ID NO: 48015 - DNA, 201 bp, Homo sapiens
tcaggtgatccaccctccttggcctcccacaatgctggctgggattacaggcgtgagctactgcacccagcttgtatttgcttagttcttttttttttttytttttttgagacagagtctcgctctgtcgcccaggctggagtgcagtggctcgatctcggctccctgcaacctccacctactgggttcaagggattctcc

SEQ ID NO: 48016 - DNA, 201 bp, Homo sapiens
ggcagaagcatttagacttggggtttctggaccattggtggtctgaagtgcacagactgaaaagaatgttggggaactggaaacaaacagggtgatacatrgattgtttctttattgaaaagctctggtcagcgatgctatccacaatgacttgcaagatgactccctctaccttcctccctgctatgatgatgcagccaa

SEQ ID NO: 48017 - DNA, 201 bp, Homo sapiens
tcctgtctgttacgggcataggatgggagaatggtaagccatgtgctacagatttgccagccctaatcctagtcaagtctttatatcttactgatggagaygctgttgattgatcaatctgttaatatcatttggtgcttacagcagtcctgtgaggtaaataggtgcgattcagccttattcacaggtgaggtagtgatc

SEQ ID NO: 48018 - DNA, 201 bp, Homo sapiens
aattgcttgaacccgggaggtggaggttgcagtgagccgagatcatgccactccactccagcctgggtgacagcaagactctgtctcaaaaaaaaaaaaaagaaagctgtacaaataatgcttttgaataatccattgttatttgtattatttcttctttattcaggcactttgtgggaattttgaacaagacctctggcc

SEQ ID NO: 48019 - DNA, 201 bp, Homo sapiens
aattctaggttcgtacaccccaaaagagttttccattacactaccgcagtgagcccaaatgtgatcaactatcagaatcacctagtagcttttttttttttcccagaaccacctcatatcctcccatcccatcctatcctttcctattccctctctatgcagagaattgctgtggggtaggggtaggggagattattgtta

SEQ ID NO: 48020 - DNA, 201 bp, Homo sapiens
gtgacacagctaggaggggcagcacctacctgtcctgtccccagtaaccaggtttatctcataaacagatggattcttgtattgaagcctttggtaccacyaaacagaagcgagctctgaacaccaggagaatgaacagagttggcaatgaatctttgaatcgtgcagtggctaaagctgcagagactatcattgatacga

SEQ ID NO: 48021 - DNA, 201 bp, Homo sapiens
agtggctcacgcctgtaatcccagcactttgggaggctgatagggtcagatcacctgaggtcaggagttcgagaccagcctggacaacatggtgaaacccrtctttattaaaaatgcaaaaattagccggggatggtggcgtgcgcctgtaatcccagctactcagcaggctgagacaggagaattgcttgaacccgggag

SEQ ID NO: 48022 - DNA, 201 bp, Homo sapiens
gaggtagtgatcactctgggatgctgagagtatccccatagtgacacagctaggaggggcagcacctacctgtcctgtccccagtaaccaggtttatctcrtaaacagatggattcttgtattgaagcctttggtaccaccaaacagaagcgagctctgaacaccaggagaatgaacagagttggcaatgaatctttgaat

SEQ ID NO: 48023 - DNA, 201 bp, Homo sapiens
tgaacagtcatgttgaggggtctctccagttcttctgtttatgtcttccttaggatgatggagatagccaaagccatgaggctgaagatctccaaaagaarggtgtctgtggccgccggcagtgaagaagatcacaaactgggcaccctgtccctcccgctgcctccagcccagacctcagaccgcctggcaaagcggagg

SEQ ID NO: 48024 - DNA, 201 bp, Homo sapiens
cctgtctgtgaaatgccactgctatgagatgacctagctagttggatgtttctattttggttggattatattcttgacctgtaactagttctttcccctgyggagtatgaagctcttcagagcccatctgaagctttcaggaacgtcacgtcagaagaaatactgaagatgattgaggagaacaggtaccctgacttaagc

SEQ ID NO: 48025 - DNA, 201 bp, Homo sapiens
tgtctgttacgggcataggatgggagaatggtaagccatgtgctacagatttgccagccctaatcctagtcaagtctttatatcttactgatggagatgcygttgattgatcaatctgttaatatcatttggtgcttacagcagtcctgtgaggtaaataggtgcgattcagccttattcacaggtgaggtagtgatcact

SEQ ID NO: 48026 - DNA, 201 bp, Homo sapiens
tacctttaagtgccagaagcccagggcctctctctcaagtcttgtggcagaattcccccaagagcttttcataccatttagaagctagcaccatctgaggyttctcttccagaagtcgtcttgcttcccctgcagggacaccccatattcccttagagatagtggggctggatcatctgccagagatgaactagttctaat

SEQ ID NO: 48027 - DNA, 201 bp, Homo sapiens
ccaagtagctgggattagaggtttgcgccaccatacctggctaatttttgtgtttttagtagagatggggtttcaccatgttggtcaggctggtcttgaaytcctgacctcaggtgttctgcctgcctcggcctcccaaagtgttgggattacaggcgtgagccaccgcgcctggccacttagttcttattttcacattcc

SEQ ID NO: 48028 - DNA, 201 bp, Homo sapiens
gttgccagctgtctccactctgcagggctcagaaggcccctgggagtgggtggatgtgggagggagtgaggggagaaaaaggggagtagtagcaaatggasctttgaagaactctgatgcccagcagcctgggatgtggggacaggctccatctttcattcatttgttctttcaacaagcatttatggaacctgcccctct

SEQ ID NO: 48029 - DNA, 201 bp, Homo sapiens
tcccgctgcctccagcccagacctcagaccgcctggcaaagcggaggaagattacctagacgcatgctttccagacagggcgttttggctgcatcacagcyactggctggtcctattcatttccatttttatgtatgttttgaaaagaaaaggtccggggatggtggctcacacctgaaatcccagcactttgggaggccg

SEQ ID NO: 48030 - DNA, 201 bp, Homo sapiens
ctcacaatcagatggaagggtttgccaggggaaccgctggttccaaggccaggtggaactgctgtttggcagggattttatgtttgcacttctctgacccractgggagagctggtggtggaggtgaccttttaggctccatctagccttgtagaggagattcagacagtaggggcagagctgcccaggaacctgaactgt

SEQ ID NO: 48031 - DNA, 201 bp, Homo sapiens
aaaagcttaagtgaggtttatttccactaaaggatagcaacataaggcagcttgacctttagtgtgactggagcaccgtaaatgctacttctacttttttyctttttttttattgtggtgaaaaacacatagcatagatttgccctctgaatgtttaagtgtacacttcattattgttaactgtatgcacaatgccatgac

SEQ ID NO: 48032 - DNA, 201 bp, Homo sapiens
gcatataccacattttccttaggcattcatctgttaatggacttttaggttgcttctgcatgttggtcattgtgaataattctgtagtgaacatggggatrcaaatgtctcttcgagttcctgtttttagttcttttgggcatatacccagaagtagggttcttgaatctcatggtagttctatttcttatttttttgagg

SEQ ID NO: 48033 - DNA, 201 bp, Homo sapiens
gggttcttgaatctcatggtagttctatttcttatttttttgaggaacctctatactgttttctgtagcagctgcaccattttacagtttcaccaacaacyctcaccaatgtagggttccagtttctctacatgctaccgatgctttgtttttttgttgttgtttgttcttgtttttttttaatagtggccatcctaatga

SEQ ID NO: 48034 - DNA, 201 bp, Homo sapiens
aaacagtggaaaaaatacatgtattttttaaatggaagggttggttatatcttcaatgtgaaatcctctatgtgaaatctaaataaactattcctggaatrtccagtgtcctttccccgtgatgataaacaaagcccagcgctgcctctctttaaagatagtaagaagcctatgcataaacaaaacacttaaaaataagat

SEQ ID NO: 48035 - DNA, 201 bp, Homo sapiens
attgttcagtttcatattagtcaccctcttctactgaactttggtaaattcaaagcttccctctatacgaatttacttttataggaatattacaaaatctrtactaagaaatattagaaaataacctgtacttaataggtttaatggaaattaaacccaaatataatggaaatctgaatgaatgctcatttaaaaaaatat

SEQ ID NO: 48036 - DNA, 201 bp, Homo sapiens
ttattttactcatccgcttaaacccatcaatgacttttaacttagaagaaaacctagtcttcctactatgaccaacaggactaagcaaatctcataacctmgcctctgcttacctctcacttcagcccaacctactctttccctctcttaaaaactcagtagctgaaatatatggagctctttctggccccgagcctccag

SEQ ID NO: 48037 - DNA, 201 bp, Homo sapiens
gtttgtctgcttttgcttttatttccttcctgtgctggactgggactcccccttatctaactggtacataccactctgcccaagcagtgcgtgtgcacacttgaacacatcccctacagctccctgctggcatctccttcatacactcttaagaagaagaaaccaatgtagaactcaagattttagcagacttacttggtc

SEQ ID NO: 48038 - DNA, 201 bp, Homo sapiens
ctctgcttacctctcacttcagcccaacctactctttccctctcttaaaaactcagtagctgaaatatatggagctctttctggccccgagcctccagacmttttaaagaaaaaaaaagattgtaattttgatgaagaccgcattgtcaatttttatttctatggctcttacttttggtattatgtctagacctctctaag

SEQ ID NO: 48039 - DNA, 201 bp, Homo sapiens
gttccacctggctggcagcacgcaccttgcaggtcaggtgtgagatgagcaagacccattggaagactggaagctacctccttctctcttttaggacaagraagcgagagagaagcgaggagaccacttgagttgtgactctcctgcttatggtgaaattaagaactaaaactaaaacaacaggaaccctttcataacgga

SEQ ID NO: 48040 - DNA, 201 bp, Homo sapiens
ccgcactcctgagcccttgggtagtcaatgggattgggcgccgcggagcagggggcggtgctcgttggggaggcttgggctgcgctggagcccacggcatytgggggaggctccggcatggtgggctgcaggtcccgagccttgccccacggggaggcagctgaggcctggtgagaattggagcgcagcgctggcaggctg

SEQ ID NO: 48041 - DNA, 201 bp, Homo sapiens
atgtggatcaccagaacaaggcaggctacacccccatcatgttggcggccctcgccgctgtggaagcagagaaggacatgcggattgtggaagaactcttyggctgtggggatgtgaatgccaaagctagtcaggttagtgcgcctggttcctgtgctcaggaatgcacccctaaccagcagacaggactgcggtggccac

SEQ ID NO: 48042 - DNA, 201 bp, Homo sapiens
gagcagcacacataagaccatcattggttctcatatgggaaaaacccttgaatattggctctaggacagattttaaggctgggtgtggtggctcgtgcctrtaatcccaacactttgggaggccgaggctggaggattgcttgaggccatgaattcaagaccagtctgggcaacctagcaagaccctttctgtacaaaaaa

SEQ ID NO: 48043 - DNA, 201 bp, Homo sapiens
aacttggtaactttccattagttgtttcccatggctccagatctgtattttaatcaagaagttacacttcttcctctcttgacttttatatcttgattttrcatgcattgttagtatcctattggtcagatgatttttgtttaattgcctgatttaatatggttttggcagccaattaacagtggatgctactgtcaagag

SEQ ID NO: 48044 - DNA, 201 bp, Homo sapiens
gcttctcttagggctgttggtttttgagagcagattctaactgcatatatatactttgactataaaaggacaggttacttgtgctttcaactaggtctcaraaagtctataaatagaagaactaacgaccacttggtgttttggcagaggttctgtctgaacaccctccagcacgagtggttccgcgtgtccagtcagaag

SEQ ID NO: 48045 - DNA, 201 bp, Homo sapiens
agtgatccacccacctcggcctcccaaagtgctgggattataggcgtgagccaccgtgcccggccaacagtgtcttgttattttaccagtgatatgcttayagttcctaattttaggcttcctccttattttggttttattgttcagtttggggaagggtgggaggcaccaatttggatctgagaaaaagatcttctgcca

SEQ ID NO: 48046 - DNA, 201 bp, Homo sapiens
aacatgcttttgagaaaaaatatcttattgttattaatagttgtggccaggtgcggtgtcatatgcctataatcccagcactttgggaggccgaggcgggyggatcacctgaggtcgggaattcgagaccagcctgaccaacatggagaaatcctgtctctactaaaaatacaaaattagccgggcgtggtgacccttacc

SEQ ID NO: 48047 - DNA, 201 bp, Homo sapiens
ctcctggcctcaagtgatccacccacctcggcctcccaaagtgctgggattataggcgtgagccaccgtgcccggccaacagtgtcttgttattttaccartgatatgcttacagttcctaattttaggcttcctccttattttggttttattgttcagtttggggaagggtgggaggcaccaatttggatctgagaaaaa

SEQ ID NO: 48048 - DNA, 201 bp, Homo sapiens
ctcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgttta

SEQ ID NO: 48049 - DNA, 201 bp, Homo sapiens
actcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgttt

SEQ ID NO: 48050 - DNA, 201 bp, Homo sapiens
aactcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtt

SEQ ID NO: 48051 - DNA, 201 bp, Homo sapiens
agtttggggaagggtgggaggcaccaatttggatctgagaaaaagatcttctgccagatgaaagagtttcaataacaggagaggaccttgggccaaagttwattaagcttgactaggaagattctgggcacatctccatccaaataccttgacacatacttcattcacccctagcacatgcagcttgtcccttcttgtctt

SEQ ID NO: 48052 - DNA, 201 bp, Homo sapiens
atttacttatatttctgaccccttataatcttcatgattgtagcctgatagtttccttttttgaatagcatttaaaaaaataccttttcttttccctgagrgttttaaagcaaataagacagaaggggtctaaatttttagttttgttttttgagacagtctcgttctgtcgcccaggctggggtgcagtggtgcaatctc

SEQ ID NO: 48053 - DNA, 201 bp, Homo sapiens
tctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatt

SEQ ID NO: 48054 - DNA, 201 bp, Homo sapiens
atctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaat

SEQ ID NO: 48055 - DNA, 201 bp, Homo sapiens
agtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccattta

SEQ ID NO: 48056 - DNA, 201 bp, Homo sapiens
taaaagcatacttagttgaataattccagaaactgggcttctttcctttgccccttcatttgcccctccctctctggtcttcccagtctccactttttttkttgtttaaataaaactgcgtttgtcagaaatgtatagacattcactcctattcttaaaagacagtgtttatccctaatgcctgccttttgattcagccag

SEQ ID NO: 48057 - DNA, 201 bp, Homo sapiens
agtgtagaatctgagttgggggaagttttacatgtgcttgataccaagcagattgggggaagggtgtcacagatatgaaaatctgattctcttactgtctsctggagtttttttttttttttttttttttttttttacttctcagtggccccaggaactgaccgattctctttcatgagttctgagagattgctggtgata

SEQ ID NO: 48058 - DNA, 201 bp, Homo sapiens
agcaggacacaaggacatcgctgttcttctgtatgcccatgtcaactttgcaaaagcccagtctccggtcagtgttgtgcatttggcatttgtaaataggytgaaatccaccagactggtggacccccttcctccaggaattgacgggagacagattttatgttgattcagaaaatggaagttttagtctggagcttaaga

SEQ ID NO: 48059 - DNA, 201 bp, Homo sapiens
gacagggtttcaccatgttggccaggatggtctcgatctcttgaccttgtgatctgcccacctcggcctcccaaagttctgggattataggtgtgagccastgtgccagccaagaattaatttcaacattagactcagccagagttaatgaagaagctttccccacatgatggctcctcacaagaaatactatctatttat

SEQ ID NO: 48060 - DNA, 201 bp, Homo sapiens
agagtctctctctgtcaccagggtggaatgcagtggcacaatctcagctcactgcaacctctgcctccatggttcaagtgattctcctgcctcagcctccygagtagctgggactgcaggcatgtgccaccacacctagctaatttttgtatttttagtagagacagggtttcaccatgttggccaggatggtctcgatct

SEQ ID NO: 48061 - DNA, 201 bp, Homo sapiens
ttcacttagcatagtgtcttcaagtttccattctattcatgttgtagcatgtgatagaatttccttttttgtaggctagataatagtccattgtatgcatrtaccacattttccttaggcattcatctgttaatggacttttaggttgcttctgcatgttggtcattgtgaataattctgtagtgaacatggggatgcaaa

SEQ ID NO: 48062 - DNA, 201 bp, Homo sapiens
actgtatgcacaatgccatgacagatctctagaacttttccatttcacatgactaaaatgctgtgctcatcaaacaactctgtttccccctgtgccagctsctggcaccaacctttctactttctgtttctatgagtttaattacatgtatgtgtcatagaaatttggctttttgtgattggcttatttcacttagcatag

SEQ ID NO: 48063 - DNA, 201 bp, Homo sapiens
cccaaaaagaacccctataccgattagcagtcattcttccatctcccagcccttctccctcattttaaggcagctacttaggaagtttttctaagatagasactgagtgagaaaactgagaggtgattaactttgatcctttttctgttactaggtttggggaaaggtgctgctgaagcaatggaagaaaaattaagtatt

SEQ ID NO: 48064 - DNA, 201 bp, Homo sapiens
atagggacaagtggaccatgctgtgaacagcacactagatagcaagtacagctgtaacaatcgttgctggagatagagcagagcttcagtcctttatgacragcttgtccaacccatggcccacaggctgcatgtggcccaggacagctttgaatgcagcccaacacaaatttgtaaacttcttaaaacatgagatttttt

SEQ ID NO: 48065 - DNA, 201 bp, Homo sapiens
aagctcataagctatcattagtgttagtgtattttatttgtggcccaagacaattcttctagtgtggcccagggaagccaaaacgttggactcccctgctktatggaaaatcgaatttgtttacattctcctgttgtattcatttttgaaattttgctaattcctaaaaggaatccacagagagcaaactctctattacta

SEQ ID NO: 48066 - DNA, 201 bp, Homo sapiens
cttttttcctcttctcaatgtaaattaagtagtatttcaaatgagattaaaaacaggatacttcttgaactttactttaaaaatacaggttcatgagcccyttaagttttgtgactttctgttgtaaaaaagactgtattcactagatggcagtgtcaacagccttttgggaagttaaatatgagtgtgactgtcctaagt

SEQ ID NO: 48067 - DNA, 201 bp, Homo sapiens
gtttcactgaacataatgacccccagtttcatccatcttgctccaaatgacaggatttaattctttttatggctggataatattctattgtgtatttttaycacactttctttttaaatatttattattattttgtagagacagagtcctgctatgttgtccaggctggtctcaaactcctggactcaagcgatccacctg

SEQ ID NO: 48068 - DNA, 201 bp, Homo sapiens
ttaataagtggggctgggaaaactggctagctatatttagaaagctgaaactgcatcccttccttacaccttatacaaaagttaattttttttttttttttgagacagggtcttgctctgtcgcccaggctggagtgcagtggcgcgatctcagctcactgcaatctccgcctcctgggttcaagtgattctcctgcctca

SEQ ID NO: 48069 - DNA, 201 bp, Homo sapiens
caagggatgtgaaggacctcttcaaggagaactacaaaccactgctcaacaaaataaaagaggacacagacaaatggaagaacattccatgcttatgaatrggaagaatcaatattgtgaaaatgaccatactgcccaaggtaatttataggttcagtgccatccccatcaagctaccaatgactttcttcacagaattgg

SEQ ID NO: 48070 - DNA, 201 bp, Homo sapiens
gccagtgatgatgagcatttttcatttgtctgttggctgcataaatgtcttcttttgagaagtgtctgttcatgtccttcgcccactttttgatggggttstttgattttttcttgtaaatttgtttaagttctttgtagaatctggatattagccctttgtcagatgggtagaagccaaatgatgagtgaactcccattc

SEQ ID NO: 48071 - DNA, 201 bp, Homo sapiens
tcgatttgcatttctctgatggccagtgatgatgagcatttttcatttgtctgttggctgcataaatgtcttcttttgagaagtgtctgttcatgtccttygcccactttttgatggggttgtttgattttttcttgtaaatttgtttaagttctttgtagaatctggatattagccctttgtcagatgggtagaagccaa

SEQ ID NO: 48072 - DNA, 201 bp, Homo sapiens
gaaggaagacgtctcctggccccacccaccgaggttcatttgattgattgtatgcaaatagccctttatttacatgccactattaagctgctaattgttcytgttggggtgacagatactgaatgtatacgtattgtgcctgagctcaccagcaaacagaagcatcaagcccaggggtaaaggctgaagctttcacagtgc

SEQ ID NO: 48073 - DNA, 201 bp, Homo sapiens
cctgttgttccctgacattttaatgatcgccattctaacaggtgtgagatggtatctcactgtggtttcgatttgcatttctctgatggccagtgatgatragcatttttcatttgtctgttggctgcataaatgtcttcttttgagaagtgtctgttcatgtccttcgcccactttttgatggggttgtttgattttttc

SEQ ID NO: 48074 - DNA, 201 bp, Homo sapiens
gttggttatatcttcaatgtgaaatcctctatgtgaaatctaaataaactattcctggaatatccagtgtcctttccccgtgatgataaacaaagcccagmgctgcctctctttaaagatagtaagaagcctatgcataaacaaaacacttaaaaataagatcatttattttattttactcatccgcttaaacccatcaat

SEQ ID NO: 48075 - DNA, 201 bp, Homo sapiens
ttctgagcggatcctgctaatccaggcatgtaaaggaggagtcctcatccaagacccaacatggtgcacacctcacaggaggaggaatggaaaagcaggcrcctttgctggactttccttttaatcccctaaatcctgtcacaccctaagactatgaaagagatgggtggagaagagccttggtgctgtggaaagggccat

SEQ ID NO: 48076 - DNA, 201 bp, Homo sapiens
catgttggtcattgtgaataattctgtagtgaacatggggatgcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaaccct

SEQ ID NO: 48077 - DNA, 201 bp, Homo sapiens
aactgtatgcacaatgccatgacagatctctagaacttttccatttcacatgactaaaatgctgtgctcatcaaacaactctgtttccccctgtgccagcygctggcaccaacctttctactttctgtttctatgagtttaattacatgtatgtgtcatagaaatttggctttttgtgattggcttatttcacttagcata

SEQ ID NO: 48078 - DNA, 201 bp, Homo sapiens
atgtttgtaaattaattttgctttagtatgacacatgtagtaacaggcctttcccctttgtaactgagtcccaggattcacggagtttgaggatcttgccktctggcttcctccttgcctcagaccctgccctttaggggttactgccctaagaggctgaaagtttagtaatgccccagggcctcgttgcaggagctagtc

SEQ ID NO: 48079 - DNA, 201 bp, Homo sapiens
ttgcttgaatccaggaggcggaggttgcagtgagccaagatcatgccactgcactccagcctgggcgacagagcatgaccctgtctcaaaaaaaaaattakatatttgggttgaaataaaaatgattttcttcttgtgaccaatcgtaacttgttttttctcctttcaggtatgaattaagtgaaaagatgttgtctgcat

SEQ ID NO: 48080 - DNA, 201 bp, Homo sapiens
aggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtct

SEQ ID NO: 48081 - DNA, 201 bp, Homo sapiens
atacatgagcacctactacgtgctgttttaggtactggggatacagcagtgaaccaaagaggcaaaaatttctgccctcaaggattgtacattctagggamagttaaagtctcctgtgtacacggttgccagaagaaaaaatactaagcacgtgttcatcgtttatctaaaattcggtttaatggtgctccactttcgtgc

SEQ ID NO: 48082 - DNA, 201 bp, Homo sapiens
ttgcccccaaaaagaacccctataccgattagcagtcattcttccatctcccagcccttctccctcattttaaggcagctacttaggaagtttttctaagrtagagactgagtgagaaaactgagaggtgattaactttgatcctttttctgttactaggtttggggaaaggtgctgctgaagcaatggaagaaaaattaa

SEQ ID NO: 48083 - DNA, 201 bp, Homo sapiens
aagagataccagaatacctgctttctgagaatttcctcaagttttactgagttcctttttaataagcatagtcacaatatgcatttgtgtgtgtgtgtgtgagagagagagagagagagagagagagataaagggaggaaggaaaaagaaatgtggttttctgccaagttcaagttccctagtgatggtgatgctgctgat

SEQ ID NO: 48084 - DNA, 201 bp, Homo sapiens
aaagagataccagaatacctgctttctgagaatttcctcaagttttactgagttcctttttaataagcatagtcacaatatgcatttgtgtgtgtgtgtgtgagagagagagagagagagagagagagataaagggaggaaggaaaaagaaatgtggttttctgccaagttcaagttccctagtgatggtgatgctgctga

SEQ ID NO: 48085 - DNA, 201 bp, Homo sapiens
gtgcagtgatgcaatcatggctcactgcagcctccgtttcctgggcccaagcaattctcttactcagccttccgagtagctggtaccaaaggtgtgcgccmccatacccagctaatttttaattttttgtagagggtctccctgtgttgcccagactggtcctgaactcctggcctcaagcaagtcctcctgcattggcct

SEQ ID NO: 48086 - DNA, 201 bp, Homo sapiens
gggtctccctgtgttgcccagactggtcctgaactcctggcctcaagcaagtcctcctgcattggccttccaaagtgctgggattatagtcttgagctacygcgcctggcatagtatcatctttttgataccaacatactataaatatattttattgcattttatttgaaactgttaatagacacgtaatttgctgatgaa

SEQ ID NO: 48087 - DNA, 201 bp, Homo sapiens
tcatggcaggatagaactaaactgatagatgaaagctccacagtgcttcaagacggggtcccgttcatgttaagcagttttccttccttcaaaataaaaarctagcagtccttagggaggacagttttttccttccttttcctattctggctccaacagctgtctcaacacagcccgagatggggagcagcctggcttcca

SEQ ID NO: 48088 - DNA, 201 bp, Homo sapiens
atagtcttgagctactgcgcctggcatagtatcatctttttgataccaacatactataaatatattttattgcattttatttgaaactgttaatagacacrtaatttgctgatgaattgtattctttgctcttttagtccatctggcatcatatgctcttcctttttgctagaattccctctttttttctttctacagaag

SEQ ID NO: 48089 - DNA, 201 bp, Homo sapiens
atgtatgtcttttctcaaactaattttttattctctttaataatgaacggataatagcaagttgcctagataactaggatttcaaagcaattttctgtccrttgaagtttgggtttgttttgttttactctcagaaaatttgcttttatcttagagtcttgcactgaaatcaattgagtaaattattacctaagtcaattc

SEQ ID NO: 48090 - DNA, 201 bp, Homo sapiens
gagtcagtcccatagtatatcctttaggtaaagacttaattaattggtgtgctttcagtttattttccctggttggtctttgcatttgtccagttaacacsagcttctggatattagatcaccataaagtccaagacatgaagaacaaatgttatatattctctttgacatttaaagacagaagatagtggtagaggagat

SEQ ID NO: 48091 - DNA, 201 bp, Homo sapiens
ttgttttttaagtatctttttttttttttttaaagacagtctctctctgtcacccaggctggagtgcagtggcacgatctcagctcactgcaatctccgcytcccgggttaaagcaattcttggtctcagtctcccaagcagctgggatgggactacaggtgcatgccaccacgcctggctaatttttttttgtattttta

SEQ ID NO: 48092 - DNA, 201 bp, Homo sapiens
tgatccattttgatggggctctctttattgtttcaggttgaatgcctttgagaacttgatgcataaaatttgcatgactcctcactcctttctggatctcycattggactcaagccagcatggctcacaccacaaaggttaacggcagtgcctcaggtaaccctgtgctctggagtttgtgtgttaaatgtatgtcttttc

SEQ ID NO: 48093 - DNA, 201 bp, Homo sapiens
attgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagt

SEQ ID NO: 48094 - DNA, 201 bp, Homo sapiens
gcggatcatgaggttaagagatggagaccatcctggctaacatggtgaaaccccatctctactaaaagttcaaaaaaattagccaggcatggtggcgggcrcctgtagtcccagctactcgggaggctgaggcgggagaatggcgtaaacccgggaggcggagcttgcagtgagctgagatcccgccactgcactgcagcc

SEQ ID NO: 48095 - DNA, 201 bp, Homo sapiens
tttgtgatcagtgagatctcagatctgataaaatgcagtgttttgtcatgagagttgctcccagccgctgatggggttgccttgttcagcactttttagcmccaggggagtaagccatgttcttgctccccctccctcaggctgaggctttgcttgatcacctgctaagacaaaaaccagagtgggtcacgagtcactctc

SEQ ID NO: 48096 - DNA, 201 bp, Homo sapiens
aattttgtttcccatagattattatgtgtagagaccccctttcagtatgtagccactggtacatccgtgggtgttatctccatactgccaggtccaatgcrgtcacctcctggatctatagtctttctccccccattccgatttcctttctctgttagcagtcatctttgtaaacagaagtctaagatttagtttgtacat

SEQ ID NO: 48097 - DNA, 201 bp, Homo sapiens
ggctagggccagatgctggcagtatttatatattcactaaataaaaatttactaagggcttgatttatatacagcccccgctaagtgaaaattacaacaamaaaaaaagaaaaacacagaatctgactaaaggagcattcagaatatttgtatctagaataacaagtataattttattggcacaatgcttttacagtatat

SEQ ID NO: 48098 - DNA, 201 bp, Homo sapiens
tctggagtcaattagcaaatcccttcatagaaatttctatcactgggtcttcgtgagcacaccttgcatctcctgaaatcccaattgccacctaggtatgmaacaacttcaagtgatgattccagctcagatgaaagctcttcttccgagtcagatgacgagtgtgatgtcattgagtatcctcttgaagaagaggaggag

SEQ ID NO: 48099 - DNA, 201 bp, Homo sapiens
ccccttccctcccttgcccctcccacatttaatgtactttggcaatagagttggccagttcagagcttttgtaattaaatgtttgcttttatctgttcctsagaggtatacacatcttgagatactaatatatacaagtgcagagtattgcaactcttagatctcttatggtagaatggcctggtacctaatcacccttgt

SEQ ID NO: 48100 - DNA, 201 bp, Homo sapiens
tcacctgaacccgaagaggtcgagactgcattgagccaagatcatgccactgccctccagcctgggcaacagagtgagattgtgtctcaaaaaaaaaaaaagaaaaagaaaaaaaaaagaaaaatggtgcttgacatcactaatcattagagaaatgcaaatcaaaaccacaatgagatattatctcacatttgttaggat

SEQ ID NO: 48101 - DNA, 201 bp, Homo sapiens
cggaagtgcccctcagacatgactgcccagtaacactcccatgcatttccgtgtgcctcctggggtggggccagtactgtctagtgttgaaaactgctggrctagagattttggtgtaggttgtgggccttgtggatttagtgaacatgatcttttaaagaaatgtatataaatctactttatatttttaaaaaatcacta

SEQ ID NO: 48102 - DNA, 201 bp, Homo sapiens
ggcataaagttaatggtattttgttaaattttaggatttttacagcatatcttggctgacactgatcttggtcctatcctagtggcaatctcttaacagtwgtgctgctggtgttatgagtaggacagttcctcattgtgtgggactgtctcgtgtgcggcagggtattctgcattcctggcccttgcccactaaatgccg

SEQ ID NO: 48103 - DNA, 201 bp, Homo sapiens
tttaaatcatactggcataaagttaatggtattttgttaaattttaggatttttacagcatatcttggctgacactgatcttggtcctatcctagtggcartctcttaacagttgtgctgctggtgttatgagtaggacagttcctcattgtgtgggactgtctcgtgtgcggcagggtattctgcattcctggcccttgc

SEQ ID NO: 48104 - DNA, 201 bp, Homo sapiens
ccaccagccttggctaatttttgtattttttagtagagaagaggttttgccatgttggccaggctggtctcaaactcctgacctcaggtgatctgcctgcstcagcctcccacagtgctgggattacaggtgtgagccaccgcacctggcctaaatatttatttttaataatgattattattacaaaagtaagaaaagagc

SEQ ID NO: 48105 - DNA, 201 bp, Homo sapiens
gaaagcagtatgatctctctcaggaaatgagattgttttctctattcaggtaataggatcttttacccatttccatctttgaggagtgattatctacttctgcagtttttttaaatgaaaaagatttatttttaaatcatactggcataaagttaatggtattttgttaaattttaggatttttacagcatatcttggctg

SEQ ID NO: 48106 - DNA, 201 bp, Homo sapiens
tgaaagcagtatgatctctctcaggaaatgagattgttttctctattcaggtaataggatcttttacccatttccatctttgaggagtgattatctacttctgcagtttttttaaatgaaaaagatttatttttaaatcatactggcataaagttaatggtattttgttaaattttaggatttttacagcatatcttggct

SEQ ID NO: 48107 - DNA, 201 bp, Homo sapiens
ccgggaggcggaggttgcagtgaactgagatcacgccacagccctcactccagcctgggtgacagagcaagactctgtctcaaaaaaaaaaaaaaaaaaaatttagatgatctctaatgccttacattgaattttttgccagctctcactcttttactatagcgtcattgttttaaaccagtcaaagtagaccacctgcat

SEQ ID NO: 48108 - DNA, 201 bp, Homo sapiens
atgaaagcagtatgatctctctcaggaaatgagattgttttctctattcaggtaataggatcttttacccatttccatctttgaggagtgattatctacttctgcagtttttttaaatgaaaaagatttatttttaaatcatactggcataaagttaatggtattttgttaaattttaggatttttacagcatatcttggc

SEQ ID NO: 48109 - DNA, 201 bp, Homo sapiens
caggcatggttgtgcacacctgtagccccagctacttgggagtctgaggcaggagaatcgcttgaacccgggaggcggaggttgcagtgaactgagatcaygccacagccctcactccagcctgggtgacagagcaagactctgtctcaaaaaaaaaaaaaaaaaaaatttagatgatctctaatgccttacattgaattt

SEQ ID NO: 48110 - DNA, 201 bp, Homo sapiens
ctagcatgaaagcagtatgatctctctcaggaaatgagattgttttctctattcaggtaataggatcttttacccatttccatctttgaggagtgattatmtacttctgcagtttttttaaatgaaaaagatttatttttaaatcatactggcataaagttaatggtattttgttaaattttaggatttttacagcatatc

SEQ ID NO: 48111 - DNA, 201 bp, Homo sapiens
aacatttggtgcaataattgctttgaaattgcagttgaataaatgaactttttgaaccagaatttggaaaggaagatatgcttaaaaaccaaaaatatttygtagagtgctacacattaggaagtcatttgtatttggtgaccactttcctaaaatagtctcatttctagagaaccaattttgtttcccatagattattat

SEQ ID NO: 48112 - DNA, 201 bp, Homo sapiens
gagataatggtgtattgataaggtacaaaagtgtgtttagcagatggggataatttttcgaccctcagtgtttgtttaaattgtttctagcatgaaagcartatgatctctctcaggaaatgagattgttttctctattcaggtaataggatcttttacccatttccatctttgaggagtgattatctacttctgcagttt

SEQ ID NO: 48113 - DNA, 201 bp, Homo sapiens
tcccattttaaattatgagtggcaagaattgtttttgttgaagcctgctttttcagtcctagcatcacacactctgtacctttctttttcctgataggcarttatttgggatatacctgtaagtgtgggggccttcagtcaggaagtcccttaagctcccagacatcccagcctgagcaagaagtggggacctcagaagga

SEQ ID NO: 48114 - DNA, 201 bp, Homo sapiens
atctccatactgccaggtccaatgcagtcacctcctggatctatagtctttctccccccattccgatttcctttctctgttagcagtcatctttgtaaacrgaagtctaagatttagtttgtacattttttaaatgatccattttgatggggctctctttattgtttcaggttgaatgcctttgagaacttgatgcataaa

SEQ ID NO: 48115 - DNA, 201 bp, Homo sapiens
tggccttcagaatccttagctggaagtctggaattaaaaattaggtgatatcccttgaggtcaggagtttgaggccaggctaaccaacatggtaaaactcrgtctctactaaaaatacaaaaattagccaggcatggttgtgcacacctgtagccccagctacttgggagtctgaggcaggagaatcgcttgaacccggga

SEQ ID NO: 48116 - DNA, 201 bp, Homo sapiens
cagccttttgggaagttaaatatgagtgtgactgtcctaagtactaaacatgggtaaaagtaggaagaccatttaattgagcataaaggatctcatttctrcgccctacaggaaagagtagttctcctttttctcctcccctcttatttgaggccgggaagaaggcgctgtgcatagcgctccaagcatctctgggtggca

SEQ ID NO: 48117 - DNA, 201 bp, Homo sapiens
tgcccttcctcaccgccagcccatcaaaatcaatcttccctcgtagtgttacctctttttcaccagatcctccatcctacttctcttgattggtacagtaytgttttcattaattcaaaacattttaggccagatggggtggcgcagacgtgtaatcccaacactttggaaggccgaggagggaggattgcttgaggccag

SEQ ID NO: 48118 - DNA, 201 bp, Homo sapiens
tgtgtgttgaggaggaagttggagttgtaaaggaatcgtccaggtagcccccatgtcccacagctaaaggagaaagcattgtgctgttgatttggggacargggactgttcaccgaattaggaaatgtgagttctcgttcagctctgtggcctggggcaagtcctgaacctagctggccttcagaatccttagctggaagt

SEQ ID NO: 48119 - DNA, 201 bp, Homo sapiens
atgaaaatatattatgagaccatctcttctttagatgtgacaaaggtaataaccatggggcaatccagactgtgaagaaagcctaaggtgtagaaagcccwtgcgacactagttttaagccttcacatgtgtttggggaaatgcgtttgttgaataaaggataagaagacagaagactttttatttttcttgtcttttaag

SEQ ID NO: 48120 - DNA, 201 bp, Homo sapiens
tatgtgtgttgaggaggaagttggagttgtaaaggaatcgtccaggtagcccccatgtcccacagctaaaggagaaagcattgtgctgttgatttggggayaggggactgttcaccgaattaggaaatgtgagttctcgttcagctctgtggcctggggcaagtcctgaacctagctggccttcagaatccttagctggaa

SEQ ID NO: 48121 - DNA, 201 bp, Homo sapiens
agctggtttctccctgcttgccaccacctgccccaagtagttccatcgccagttctttcccttctgtcaccacactcttccccctttccctagcacagccycactagaggccaccactgccagctcagtacgtacttctgaagtccttgtcatctcttcccataggcgggacagacggccctcatgctggcggtcagtcac

SEQ ID NO: 48122 - DNA, 201 bp, Homo sapiens
atcttcagtgaactaataaaagtatttccttttcccttttctggcaatgggtagtctagttctgttaatattcctgcaaagaaactcatctaccagcctcmctcacactgtgcacttttgccctcagaatcctcagtggctagcctaattgactacaaccagtttagatgatcagctaccttccttttgccattatttcag

SEQ ID NO: 48123 - DNA, 201 bp, Homo sapiens
gtattcactagatggcagtgtcaacagccttttgggaagttaaatatgagtgtgactgtcctaagtactaaacatgggtaaaagtaggaagaccatttaaytgagcataaaggatctcatttctacgccctacaggaaagagtagttctcctttttctcctcccctcttatttgaggccgggaagaaggcgctgtgcatag

SEQ ID NO: 48124 - DNA, 201 bp, Homo sapiens
tacttcttgaactttactttaaaaatacaggttcatgagccctttaagttttgtgactttctgttgtaaaaaagactgtattcactagatggcagtgtcamcagccttttgggaagttaaatatgagtgtgactgtcctaagtactaaacatgggtaaaagtaggaagaccatttaattgagcataaaggatctcatttct

SEQ ID NO: 48125 - DNA, 201 bp, Homo sapiens
ttccagaccaacctggacaacatggtgaacccctgtctctacaagaaatacaaaaattagctaggcgtggtggcatgcacctatagtctcagttacccatwagactgaggtgaggaggctgaggcaggaggatcacctgaacccgaagaggtcgagactgcattgagccaagatcatgccactgccctccagcctgggcaa

SEQ ID NO: 48126 - DNA, 201 bp, Homo sapiens
cccaggaggttgaggctacagtgagctgtgattgcaccgctgtactccagcctaagtgacagagtgatacactatctcaaaaaagaacttttttttttttkaggtaatgaatttaaatcattaggggaacataccattcttactaactttttgaaacaaaaacaaaggttgctcgaagatgttatgaataaaatgtttaag

SEQ ID NO: 48127 - DNA, 201 bp, Homo sapiens
tttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtccc

SEQ ID NO: 48128 - DNA, 201 bp, Homo sapiens
agatggatctagtacgtacctggaggattgcatagaagcatcctgacaagggtgccaagaatacgcagtgggggaaaggacagtctcttcgaagaatactkttgggaaaactggatatccacatgccaaaaaataaaattggacccttaacaccatatacaaaaatcaacttgaaatggattaagacttaactgtaagagg

SEQ ID NO: 48129 - DNA, 201 bp, Homo sapiens
agtctaatttgccgacagctgcaaagcagcagagccaggattcaaacccaggcagtctggccccagagtgcctgcttcaaatcactacatctcttcctctsttatacttattcatcagtagatgcctagatgtggggctttacacttcagcagatactaagagggccatgtaccaagcgccaagtactgaggaatacaaac

SEQ ID NO: 48130 - DNA, 201 bp, Homo sapiens
ctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcc

SEQ ID NO: 48131 - DNA, 201 bp, Homo sapiens
agtaaatgataaatgcataatgacctaaatgtcagatggatctagtacgtacctggaggattgcatagaagcatcctgacaagggtgccaagaatacgcartgggggaaaggacagtctcttcgaagaatactgttgggaaaactggatatccacatgccaaaaaataaaattggacccttaacaccatatacaaaaatca

SEQ ID NO: 48132 - DNA, 201 bp, Homo sapiens
ctgaaaagttctcgtttttacctttttttcatggccatgatggttttaaaaagagaggcctgacattctgtagaatgtgtttcaggcagggtccaggccaygccttcttggcaggacagtgcaaaagtgatgctctgctcttccccatgcagatacatgatgtcaactttgatcacctggtcgaggtggttatttgtcagc

SEQ ID NO: 48133 - DNA, 201 bp, Homo sapiens
cctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtc

SEQ ID NO: 48134 - DNA, 201 bp, Homo sapiens
tggagacaggtctggctgctgcagcttctctcctgttaatggaatttcagacagtcctggagacaggtctggctgctgcagcttctctcctgttaatggartttcagacagtcctggagacaggtctggctgctgcagcttctctcctgttaatggaatttcagacagtactggagacaggtctggctgcatattttgagt

SEQ ID NO: 48135 - DNA, 201 bp, Homo sapiens
cccggcagtctgcctacgctaatgaaatcaggaaagctggagcgtcaaaggggcttctgagttttggtggctgggataatagtcccattttaaattatgartggcaagaattgtttttgttgaagcctgctttttcagtcctagcatcacacactctgtacctttctttttcctgataggcaattatttgggatatacctg

SEQ ID NO: 48136 - DNA, 201 bp, Homo sapiens
gcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagt

SEQ ID NO: 48137 - DNA, 201 bp, Homo sapiens
atgcagctgtagggacacttgttcagatgagaaattgtggggtcagcgtgacagaggccatgcttggagtgatgactgaagctgacaaagaaattgagctscaacagcagaccatagaatccttgaaggaaaagatctatcgcctagaagtacagcttagagaaaccacccatgaccgggagatgactaaactgaaacaag

SEQ ID NO: 48138 - DNA, 201 bp, Homo sapiens
tggcctctatggtaacttttctcactcacagtcattggcatcaggattctagggccagcattgccagcattccaatttaatgtcaatgtaccttttaaatygacctggaagaaagttaatatcgttatttggaaggtaggcccagaatatctttaaataaggttaccaaagaggccgggcatggtggctcacacctgtgat

SEQ ID NO: 48139 - DNA, 201 bp, Homo sapiens
gatttttgcaatctgtgtttttttaatagccagttattggagataagaaagagaaattcagtacaaagtctaagatgtcccagtgatgcactctgactggktgtcattatctcaacaggaatgaatgtagttcaacagtatgtaggcccggtttcttagacatgatgtctgctgaaatggtgataaggtatcccacattat

SEQ ID NO: 48140 - DNA, 201 bp, Homo sapiens
cacatttatttatttatttacgagacagagtctcgccctgtcacacaggctaaagtgcagtggcgtgatctcagctcactgcaacctccacctgctggttsaagcaattctcctgcctcagcctcccgagtagctgggactacaggcacacgccaccacacccagttaatttttgtatttttactagagacagggtttcac

SEQ ID NO: 48141 - DNA, 201 bp, Homo sapiens
tgttcagatgagaaattgtggggtcagcgtgacagaggccatgcttggagtgatgactgaagctgacaaagaaattgagctgcaacagcagaccatagaakccttgaaggaaaagatctatcgcctagaagtacagcttagagaaaccacccatgaccgggagatgactaaactgaaacaagagctgcaggctgctggatc

SEQ ID NO: 48142 - DNA, 201 bp, Homo sapiens
actaaaaacaacaggcaaactaaagaatcttttagtaagtcacagacaattgtcactgaaccaagagcccagcccacggggccagttcctcaccgactctrtgccttaatttccaatgtgtaagcttggatgactacacttatctccaggattcagtgtaggacatagaaaaaagtacaggactcaagtaatgattgaact

SEQ ID NO: 48143 - DNA, 201 bp, Homo sapiens
catatttatatatgtattctgattgtgattactcctacatacaatttttaatatagtacaaaatcgtacatatataattttatggtacccatccccccccygccctttttttgagacagggtctcaggctggagtgcagtgatgcaatcatggctcactgcagcctccgtttcctgggcccaagcaattctcttactcagc

SEQ ID NO: 48144 - DNA, 201 bp, Homo sapiens
cctctggctgaggactaacgctggaagaaaagtaaactggtgttggctggcctagaggttgtcttctggggctgctagtttggtaagatgctttattcttwgtctttcagttatttacttgctcattatttatagaactgcctttaaaaaaatcctaccctgtttgtacccactattaccagtatattagcaattgaaata

SEQ ID NO: 48145 - DNA, 201 bp, Homo sapiens
gaacgtgggaggcagaggttgcagtgagcccagattgcaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaac

SEQ ID NO: 48146 - DNA, 201 bp, Homo sapiens
gaccacactgcctggcttccgtttctggctctccaattctcatgaatcagtgtgacctgggaaagagtgtgcattagattaattttacatgaaaatgtgtratacagacttaagccatccacagaaattccagtctttctattagtgtctgatggggcaatgattaaaatagactgaaatatattatttttatatcttcct

SEQ ID NO: 48147 - DNA, 201 bp, Homo sapiens
  misc_feature (1)...(201): n = A,T,C or G, or insertion/deletion polymorphism (see Tables 1-2)
aaagttcttggcactatcaatacaaatgtagatcagcataccagaacagttggaataggtgaacagagcaacttttaaaatccattttaatatattttttnaaattgattttctaacaaatttggaaacccatggctatataccaataactaatacccattctggacagataaatgttacacagaagactggagaattgat

SEQ ID NO: 48148 - DNA, 201 bp, Homo sapiens
tgaacgtgggaggcagaggttgcagtgagcccagattgcaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaa

SEQ ID NO: 48149 - DNA, 201 bp, Homo sapiens
cacccacctcggcctcccaaagtgctgggattataggcgtgagccaccgtgcccggccaacagtgtcttgttattttaccagtgatatgcttacagttccyaattttaggcttcctccttattttggttttattgttcagtttggggaagggtgggaggcaccaatttggatctgagaaaaagatcttctgccagatgaaa

SEQ ID NO: 48150 - DNA, 201 bp, Homo sapiens
tattaatccatggctcctcacgagccttaaaacagagaataaaacttgtcaaagaagaaaaatagaaaattagagaaaataacctcactacttattttcargcaccttgtgacttaagaaaatgtttttaaatgtggactctacattttatgaacttaaatttagtgtctgttggtcaaaatccacaggacctttaggaga

SEQ ID NO: 48151 - DNA, 201 bp, Homo sapiens
aaattgtctccaccttattaatccatggctcctcacgagccttaaaacagagaataaaacttgtcaaagaagaaaaatagaaaattagagaaaataacctsactacttattttcaggcaccttgtgacttaagaaaatgtttttaaatgtggactctacattttatgaacttaaatttagtgtctgttggtcaaaatccac

SEQ ID NO: 48152 - DNA, 201 bp, Homo sapiens
aaaaagaatcttcagtttgttggcattaatggagggtaaggaaagatggtggttctagaggctaatgctgtcagtctcctttacctcctgcctaagtcacrtttcaaggcgcctagtcggggaagcggccacagcgcagtgatgaaagattccctcctcagaaaggcagaaaggtgcatttgggctttgctttcctcctct

SEQ ID NO: 48153 - DNA, 201 bp, Homo sapiens
ttgaacgtgggaggcagaggttgcagtgagcccagattgcaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaa

SEQ ID NO: 48154 - DNA, 201 bp, Homo sapiens
acagatggaggttacagtgagccaagattgtgccactgcacttcagcctgtgtaacagagtgagactgtctcaaaaaataatgataatagtaagtttcctmaggcttccccagccatgcagaactgtgagtcaattaaaccttttttcttcataaattgctcagtctcaggtagttctttatagcagtgtgaaaatggact

SEQ ID NO: 48155 - DNA, 201 bp, Homo sapiens
gggaagctgaggtaggagaatcgattgaacctgacagatggaggttacagtgagccaagattgtgccactgcacttcagcctgtgtaacagagtgagactstctcaaaaaataatgataatagtaagtttcctaaggcttccccagccatgcagaactgtgagtcaattaaaccttttttcttcataaattgctcagtctc

SEQ ID NO: 48156 - DNA, 201 bp, Homo sapiens
cagtctggccaacatggcgaaacctgtctctactgaaaaaacaaaaattagccgggcgggtggcgcacacctgtaatctcagctgttcgggaagctgaggyaggagaatcgattgaacctgacagatggaggttacagtgagccaagattgtgccactgcacttcagcctgtgtaacagagtgagactgtctcaaaaaata

SEQ ID NO: 48157 - DNA, 201 bp, Homo sapiens
gtctttaagattcagtaagctagcaactcaagaaaagcacaagtagtcaccatatagggacaagtggaccatgctgtgaacagcacactagatagcaagtrcagctgtaacaatcgttgctggagatagagcagagcttcagtcctttatgacaagcttgtccaacccatggcccacaggctgcatgtggcccaggacagc

SEQ ID NO: 48158 - DNA, 201 bp, Homo sapiens
actctttcgaaccccagtttagaccagcagcagctctcctaatggggagtcaagaagtagtaagagaccctaagagtcatataagacacaaatcacctttrcctgtgatatttgccatacatatgcctatggttacatgcagaggatcccaacaggagcatcatacacacagcaaataacactaatgtgttttatttatat

SEQ ID NO: 48159 - DNA, 201 bp, Homo sapiens
tgtggctgtgggtgccgaggagaacatgaacgacatcgtcgtgtaccacagaggctccaggtcctgtaaggatgcagctgtagggacacttgttcagatgmgaaattgtggggtcagcgtgacagaggccatgcttggagtgatgactgaagctgacaaagaaattgagctgcaacagcagaccatagaatccttgaagga

SEQ ID NO: 48160 - DNA, 201 bp, Homo sapiens
tgggttcaagcgactctcctgcctcagcctcccaagtagctgggactacaggcatgcaccaccatgcccagctaatttttgtatttttagtagagatgtgrtttcaccatgttggccaggatggtctcaatctcttgacctcatgatccgcctgcctcagcctcccaaagtgctgggattataggtgtgagctgttgcacc

SEQ ID NO: 48161 - DNA, 201 bp, Homo sapiens
gtcccagtgatgcactctgactggttgtcattatctcaacaggaatgaatgtagttcaacagtatgtaggcccggtttcttagacatgatgtctgctgaartggtgataaggtatcccacattatcggtgtttttttgaagacagcctttagggtttcagtgtcatcatctttatgccttttgctaaaacagtttatgttc

SEQ ID NO: 48162 - DNA, 201 bp, Homo sapiens
ccggtctgtggctgtgggtgccgaggagaacatgaacgacatcgtcgtgtaccacagaggctccaggtcctgtaaggatgcagctgtagggacacttgttsagatgagaaattgtggggtcagcgtgacagaggccatgcttggagtgatgactgaagctgacaaagaaattgagctgcaacagcagaccatagaatcctt

SEQ ID NO: 48163 - DNA, 201 bp, Homo sapiens
gtggtgcaatctcagctcatcgcaaccttcacctcctgggttcaagtgattgtcctgcctcagcctcctgaatagctgggactacaggcacaggccaccasgcccggctaaatttttttttattattatttttagtagagacggggtttaaccttgttggccaggctggtctcgatcttctaacctcatgatccacccgcc

SEQ ID NO: 48164 - DNA, 201 bp, Homo sapiens
tctaagatgtcccagtgatgcactctgactggttgtcattatctcaacaggaatgaatgtagttcaacagtatgtaggcccggtttcttagacatgatgtstgctgaaatggtgataaggtatcccacattatcggtgtttttttgaagacagcctttagggtttcagtgtcatcatctttatgccttttgctaaaacagt

SEQ ID NO: 48165 - DNA, 201 bp, Homo sapiens
atgatgtaggtagtggaaggcctagaagtcagaagagctgacctctcatactggctgtgtaggtaacttgctgtgtcttttttttttttttttttttttttttttactcttaagacagggtctcactctgtcacccaggctagagtgcagtggcatgatcacagcttgctgtagcctgaacttcccgagctctaaccatcc

SEQ ID NO: 48166 - DNA, 201 bp, Homo sapiens
agacaaagtctttctctgttgcccaggctggagtgcagcggtgcagtctcagctcactgcaacctccgcctcccgggttcaaccgattttcctgcctcagsctcctgagtagctgggattacaggcgcatgccaccacacccggctaattttttgtatgtttagtagagatggggtttcaccgtgttagccaggatggtct

SEQ ID NO: 48167 - DNA, 201 bp, Homo sapiens
gtgagttcagaaggcccaggctggccagttttggaggcatgggcaccacaagctccctcccttcttttgtgggttctggaaaccacaatcctgccaagcascagcttcagaatggataccaaggtaatggggattatggtagctatgccccagctgctcccaccacttcctccatggggagctccatccgccacagccccc

SEQ ID NO: 48168 - DNA, 201 bp, Homo sapiens
aataattattgaatttgagccaggtgcaatggtacacatccgtagtcccagctactctagaggctgaggcgggaggattgctagagcccagaaatttgagrccagcctgggcaacttagtaagacctccatttctaaaaaaatatgaagtaaaaatcattattacttggattcctactctgtctcaagctataggctgtga

SEQ ID NO: 48169 - DNA, 201 bp, Homo sapiens
tgttcctaggtttttttgttttgttttgttggttttcttttttttttttttttttttttttttttgagacagtctcattctgttgcccaggctggagtgcrgtggcacgacctcggctcactgcaacctcctcctcctgggttcaagcgattctcatgcctcagcctcctgagtagctgagattacaggcgcacaccacta

SEQ ID NO: 48170 - DNA, 201 bp, Homo sapiens
tccttcatgaataatctctactgcctgttccccaaaccatcatttgggcttaaagagtgaattcatgctcgagccctttttttttttttttttttttttttgagacacagtcacactctgtcacccaggctggagtgcagtggtgcaatctcagctcatcgcaaccttcacctcctgggttcaagtgattgtcctgcctca

SEQ ID NO: 48171 - DNA, 201 bp, Homo sapiens
tggctgctgcagcttctctcctgttaatggagtttcagacagtcctggagacaggtctggctgctgcagcttctctcctgttaatggaatttcagacagtmctggagacaggtctggctgctgcagcttctctcctgttaatggagtttcagacagtcctggagacaggtctggctgctgcagcttctctcctgttaatgg

SEQ ID NO: 48172 - DNA, 201 bp, Homo sapiens
tggagacaggtctggctgctgcagcttctctcctgttaatggagtttcagacagtcctggagacaggtctggctgctgcagcttctctcctgttaatggartttcagacagtcctggagacaggtctggctgctgcagcttctctcctgttaatggagtttcagacagtcctggagacaggtctggctgctgcagcttctc

SEQ ID NO: 48173 - DNA, 201 bp, Homo sapiens
attctggcaatgccagctgtcatgtagctgtttgcttcacttctgcctttaattacttttctatgcaccccatccccactagactgtgagccttgtgagarcagagactttgtccattttgttcggtgcccccagctccgagaacagtgcatggtaaatagtaagtgaagatccatagaaaactagagagatagagaaaga

SEQ ID NO: 48174 - DNA, 201 bp, Homo sapiens
ttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgt

SEQ ID NO: 48175 - DNA, 201 bp, Homo sapiens
tttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatg

SEQ ID NO: 48176 - DNA, 201 bp, Homo sapiens
agcactggcttgtcagggccacagctgctatgactctttctttctgtgagcaccccgatcccctagtccgctctttcactggatacctgtgtctaagtacrttttttcatccatcgctcagccagaatctgccggtcagacctggcaagtatttatagaagaaatgaatcaatattacatctctaaccacaagattgcaca

SEQ ID NO: 48177 - DNA, 201 bp, Homo sapiens
gagaccccctatggttatcaactagacttagatttcctcaaatatgtggatgacatacagaagggaaataccatcaaaagactgaacatccagaagaggcrgaagccgtccgtgccatgcccagaacccaggaccacatctggtcagcaaggtatatggacttccactgaatccctctcatcctccaacagtgatgacaac

SEQ ID NO: 48178 - DNA, 201 bp, Homo sapiens
agataagcttgaaaatttctcagtacgttgaggtttggggtggggaggaacctgggaggtgctggattggggctaaattgttgacatttcgtgccacagaraagagcttttaggctttcttctttaaagtggagctcctggcacatcactttgcaaggatagtgattgagaagttgtagacgtttccaggaatacctgaaa

SEQ ID NO: 48179 - DNA, 201 bp, Homo sapiens
ccctatggttatcaactagacttagatttcctcaaatatgtggatgacatacagaagggaaataccatcaaaagactgaacatccagaagaggcggaagcygtccgtgccatgcccagaacccaggaccacatctggtcagcaaggtatatggacttccactgaatccctctcatcctccaacagtgatgacaacaagcag

SEQ ID NO: 48180 - DNA, 201 bp, Homo sapiens
tgtctgcttttgcttttatttccttcctgtgctggactgggactcccccttatctaactggtacataccactctgcccaagcagtgcgtgtgcacacttgaacacatcccctacagctccctgctggcatctccttcatacactcttaagaagaagaaaccaatgtagaactcaagattttagcagacttacttggtcttg

SEQ ID NO: 48181 - DNA, 201 bp, Homo sapiens
ttgctgtactgcaacaaacacaaatattagtttttaccattaggtgtattgcatgtcattataatattcttttctccctcttctaggaaaagcaggtgatrttctcagtggagaccaggacaaggaacagaaagacccttactttgtggagaccccctatggttatcaactagacttagatttcctcaaatatgtggatga

SEQ ID NO: 48182 - DNA, 201 bp, Homo sapiens
ttgtctgcttttgcttttatttccttcctgtgctggactgggactcccccttatctaactggtacataccactctgcccaagcagtgcgtgtgcacacttgaacacatcccctacagctccctgctggcatctccttcatacactcttaagaagaagaaaccaatgtagaactcaagattttagcagacttacttggtctt

SEQ ID NO: 48183 - DNA, 201 bp, Homo sapiens
ggtcccgagccttgccccacggggaggcagctgaggcctggtgagaattggagcgcagcgctggcaggctgacactgctagggaacccagcgcaccctccrcagctgctggctggagtgctaagcccctcactgcccaggggccggccgctccaagtgtggggcccgccgagcccacacctacccagaactcctggcctac

SEQ ID NO: 48184 - DNA, 201 bp, Homo sapiens
tttgtctgcttttgcttttatttccttcctgtgctggactgggactcccccttatctaactggtacataccactctgcccaagcagtgcgtgtgcacacttgaacacatcccctacagctccctgctggcatctccttcatacactcttaagaagaagaaaccaatgtagaactcaagattttagcagacttacttggtct

SEQ ID NO: 48185 - DNA, 201 bp, Homo sapiens
ttgaaatagcagatccaaataatttcatattactttacacaacaagacctccattagtaagagatttgggttagattttttcttcctttttttttttttttactttaaactttattgagctgttttacataccatagaattcacccattttaagtgtatggtttgataagttttagtatatgtggacagttgtatatccac

SEQ ID NO: 48186 - DNA, 201 bp, Homo sapiens
tttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcct

SEQ ID NO: 48187 - DNA, 201 bp, Homo sapiens
ataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaa

SEQ ID NO: 48188 - DNA, 201 bp, Homo sapiens
ctagaggttgtcttctggggctgctagtttggtaagatgctttattctttgtctttcagttatttacttgctcattatttatagaactgcctttaaaaaaatcctaccctgtttgtacccactattaccagtatattagcaattgaaatactggcataaaatgttttcagttaaaacgtttatgagaggagagactccatt

SEQ ID NO: 48189 - DNA, 201 bp, Homo sapiens
cttatcttcattctttgcatctgtttgaactcatgacaatacaaaacaaggtgttcctgggatagggaatgttttgtccaaaaggagtcaacacggagaaractcttcctacagttaagacagggtttggttttgtttttaaatgaggagagaaactgagaagtggaaaacacaaaatagagttgaagtctttcctctgtg

SEQ ID NO: 48190 - DNA, 201 bp, Homo sapiens
ggtcaagtgtaggccataaagattttcccactcctcctcttgaatcaggcatggccttgtgaattactttggcccatagaatgcggcaaagtgatactgtrcaagttctagccttggtcttaagcctgccagcttttgctttcactcccttggagccctgagctagtatagaaagagatccagctgcaaggactggttaca

SEQ ID NO: 48191 - DNA, 201 bp, Homo sapiens
ccttggtcttaagcctgccagcttttgctttcactcccttggagccctgagctagtatagaaagagatccagctgcaaggactggttacacaatttgcagsgattagtgtaaaaggaaatgcaggtttccttgttttaaaattattccgaattttaaggcggtgacaacagagccctataccaagcagaggcttgatccga

SEQ ID NO: 48192 - DNA, 201 bp, Homo sapiens
gcctgacacactactgtatccagctgcctgacccagtcctgcccacctgccttcctttcttcctgcctcccctctgttttatcaactttgtctcaaaaaaacatagcttcctatctctatatgttcgtctcctatttatggtccctcagtatgttatagtgcttgctaaggtttgaatgtcccatgtgaatctcatgttga

SEQ ID NO: 48193 - DNA, 201 bp, Homo sapiens
aatttgtaaatgtggaggagctagaggaacaacttgatttcacttgtcactaaacttatctaataaataaaaatgaggatttattattattattattattwttttgagacagagtctcgctctgtcacccaggctggagtgcagtggcgcaatcttggctcactgcaagctccacctcctgggttcacgccattctcttgc

SEQ ID NO: 48194 - DNA, 201 bp, Homo sapiens
tccttggcagtgcagcccttgtgtacactcttggaaagatactaatgtttactttcatgatgtagaatggatgagcagtgaaggtttctaggaaggttgarcacactcatgcccactttgggacacaaggaggcagatgctctcatgggaactcttcaaataaggtcgtatggtttggctgtatcctcacccagatctcat

SEQ ID NO: 48195 - DNA, 201 bp, Homo sapiens
tattgcttaggttatcatccaggtttttgagtattacatttaagtttttaatccttcttgagttgatttttgtatatgatgtaaggaaggggtccagtttsaattttctgcacatggctagccagttatcacagcaccatttattcaacagggagtcctttccccattgcttgtttttgtcaggtttgtcaaagatcagat

SEQ ID NO: 48196 - DNA, 201 bp, Homo sapiens
tagctgggattacaggcacccgccaccacgcctggctaatttttgtatttttagtagagatggggtttcaccttgttggccaggttggtctcaaactcctracctcaggtgatccacccaccttggcctcccaaagtcctaggattacaggcgtgagccaccacgccaggcctaaacccttacttaactaaaacttgtttt

SEQ ID NO: 48197 - DNA, 201 bp, Homo sapiens
gatattctcagtggagaccaggacaaggaacagaaagacccttactttgtggagaccccctatggttatcaactagacttagatttcctcaaatatgtggwtgacatacagaagggaaataccatcaaaagactgaacatccagaagaggcggaagccgtccgtgccatgcccagaacccaggaccacatctggtcagcaa

SEQ ID NO: 48198 - DNA, 201 bp, Homo sapiens
aggttaacggcagtgcctcaggtaaccctgtgctctggagtttgtgtgttaaatgtatgtcttttctcaaactaattttttattctctttaataatgaacrgataatagcaagttgcctagataactaggatttcaaagcaattttctgtccattgaagtttgggtttgttttgttttactctcagaaaatttgcttttat

SEQ ID NO: 48199 - DNA, 201 bp, Homo sapiens
gactcaagccagcatggctcacaccacaaaggttaacggcagtgcctcaggtaaccctgtgctctggagtttgtgtgttaaatgtatgtcttttctcaaastaattttttattctctttaataatgaacggataatagcaagttgcctagataactaggatttcaaagcaattttctgtccattgaagtttgggtttgttt

SEQ ID NO: 48200 - DNA, 201 bp, Homo sapiens
caggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctca

SEQ ID NO: 48201 - DNA, 201 bp, Homo sapiens
ttttaacttgacctagtgtaattccttcatgcagtaaacttgaaagagccatgctgtctagtcttgaagtccctcatttaaacagaggtcaagcagtaggygcctggcagtgtcaagcctgaaacaaagcaatactgtcatgtttcagccacacctagagccctaagatcatagacaactacgtctggccagaagctcctc

SEQ ID NO: 48202 - DNA, 201 bp, Homo sapiens
tacagtcaacactgtcattcacttgtgattttcattttttccaagcttagaaaacttgaaggatgatgacttttttattggagaggttaaaaaaaaaaaaagtaggtaaaagtgatggatgcttaggctgagggtggtgactgaatatgtggtacttgaaattgagtttgagtgtccaggcctggtttcattatatcttgg

SEQ ID NO: 48203 - DNA, 201 bp, Homo sapiens
gtacagtcaacactgtcattcacttgtgattttcattttttccaagcttagaaaacttgaaggatgatgacttttttattggagaggttaaaaaaaaaaaaagtaggtaaaagtgatggatgcttaggctgagggtggtgactgaatatgtggtacttgaaattgagtttgagtgtccaggcctggtttcattatatcttg

SEQ ID NO: 48204 - DNA, 201 bp, Homo sapiens
tgtacagtcaacactgtcattcacttgtgattttcattttttccaagcttagaaaacttgaaggatgatgacttttttattggagaggttaaaaaaaaaaaaagtaggtaaaagtgatggatgcttaggctgagggtggtgactgaatatgtggtacttgaaattgagtttgagtgtccaggcctggtttcattatatctt

SEQ ID NO: 48205 - DNA, 201 bp, Homo sapiens
ctgagaggttgagcctgcagtgagatgaaattgcgccagtgcacttcagcctgtgtgacagagcaagaccatgtctcaaaaggaaaaaaaaaaaaaaaaaaatttattcattagttataaatgcacactgatgttcttataagtgaaaagatatattgttttggttttgctttaagattccagcaaatataaaacagaaaa

SEQ ID NO: 48206 - DNA, 201 bp, Homo sapiens
tgagaggttgagcctgcagtgagatgaaattgcgccagtgcacttcagcctgtgtgacagagcaagaccatgtctcaaaaggaaaaaaaaaaaaaaaaaaatttattcattagttataaatgcacactgatgttcttataagtgaaaagatatattgttttggttttgctttaagattccagcaaatataaaacagaaaaa

SEQ ID NO: 48207 - DNA, 201 bp, Homo sapiens
actggtggacccccttcctccaggaattgacgggagacagattttatgttgattcagaaaatggaagttttagtctggagcttaagagttcatcctttccrcctccaccccgcaaaaagcaggagaactaatgttttagcagaggctggaccttgcttgtccttgcaagacatatgctcacagcttcccatagaggttttg

SEQ ID NO: 48208 - DNA, 201 bp, Homo sapiens
cctgagaggttgagcctgcagtgagatgaaattgcgccagtgcacttcagcctgtgtgacagagcaagaccatgtctcaaaaggaaaaaaaaaaaaaaaaaaatttattcattagttataaatgcacactgatgttcttataagtgaaaagatatattgttttggttttgctttaagattccagcaaatataaaacagaaa

SEQ ID NO: 48209 - DNA, 201 bp, Homo sapiens
ggctgcagtgagccatgattgtgttactgcactccagcctgggtgacagacagcgagaccctgtctcaaaaagaatgcaattgtaattttgtcacctttakttaaaaaaatcatttatcaggtggttgcaatgaaaagcaatttagttgtttacaacctctaccttctagggacttaagtgtgttcagaagtatttaaaat

SEQ ID NO: 48210 - DNA, 201 bp, Homo sapiens
acagccagcagaaggagcgtgggggttggggatgaccctgtaggggaatctctggagaacccccagcctcaagctccacttggaatgatgactggcctggrtcactacattgagcgtatccagaagctgctggcagaacagcagacactgctggctgagaactacagtgaactggcagaagctttcggggaacctcactca

SEQ ID NO: 48211 - DNA, 201 bp, Homo sapiens
gtcaacatccaggatgacgagggctccacggccctcatgtgtgccagcgagcacgggcacgtggagattgtcaagctgctgctggcccagcccggctgcarcggtcacctagaggacaacgtaagctgtctccattgggcctcctggccaggggtctgggggactctggacgggagctctgggagtgccttttggccagga

SEQ ID NO: 48212 - DNA, 201 bp, Homo sapiens
gacagtaattctaataatcatccagccgggcgtggtagctcacgcctgtaaccccagcactctaggaggccaaggcgagtggatcacctgcggtcaggagytcgggaccagcctggctaacgtggtgaaacctcgtctctactaaaaatacaagaaattagccgggcatgatggcacacgcttgtaatcccagctactcgg

SEQ ID NO: 48213 - DNA, 201 bp, Homo sapiens
aaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgg

SEQ ID NO: 48214 - DNA, 201 bp, Homo sapiens
acttctgctcaggtctcacccccagagattagttcaattggtctttgatgagacctagacagtaattctaataatcatccagccgggcgtggtagctcacrcctgtaaccccagcactctaggaggccaaggcgagtggatcacctgcggtcaggagctcgggaccagcctggctaacgtggtgaaacctcgtctctacta

SEQ ID NO: 48215 - DNA, 201 bp, Homo sapiens
tcgtttctcatccattgtctgctttgaccctatgagcccatgagcacctagcagcatccacatttttaaatgaattttaagtcacccttctaagacataartatttttgtttcaggtaccaatatattgtttgaaagagataccagaatacctgctttctgagaatttcctcaagttttactgagttcctttttaataagc

SEQ ID NO: 48216 - DNA, 201 bp, Homo sapiens
ttttttcaaacactaactcaaccagaagggacaatgtaatatatttaccactcaatcgtttctcatccattgtctgctttgaccctatgagcccatgagcmcctagcagcatccacatttttaaatgaattttaagtcacccttctaagacataaatatttttgtttcaggtaccaatatattgtttgaaagagataccag

SEQ ID NO: 48217 - DNA, 201 bp, Homo sapiens
gaagcaattctccagtctcagcctctcaagtagctgcgttacaggtgcccgccaccatgcccagctaatttttgtatttttagtagagacctggtttcacyatgttggccaggctggtctcaaactcctgacctcaggtgatccagccgcctcggcctcccaaagtgctgggattacaggcatgagccaccatgccatttt

SEQ ID NO: 48218 - DNA, 201 bp, Homo sapiens
gtcacctagaggacaacgtaagctgtctccattgggcctcctggccaggggtctgggggactctggacgggagctctgggagtgccttttggccaggagcsaccaaatcctcctctattctcctctgggatttgtgtcgccatctaggtgcctcccttcacagccaagcttggctacacttactgtgtgtgtgcaaactaa

SEQ ID NO: 48219 - DNA, 201 bp, Homo sapiens
gccttctgggttgaaggttgaagcaattctccagtctcagcctctcaagtagctgcgttacaggtgcccgccaccatgcccagctaatttttgtatttttrgtagagacctggtttcaccatgttggccaggctggtctcaaactcctgacctcaggtgatccagccgcctcggcctcccaaagtgctgggattacaggca

SEQ ID NO: 48220 - DNA, 201 bp, Homo sapiens
acaggacaatagaattttttttttcaaacactaactcaaccagaagggacaatgtaatatatttaccactcaatcgtttctcatccattgtctgctttgaycctatgagcccatgagcacctagcagcatccacatttttaaatgaattttaagtcacccttctaagacataaatatttttgtttcaggtaccaatatatt

SEQ ID NO: 48221 - DNA, 201 bp, Homo sapiens
gttaatattgaaggtttgaagtctgccagggtggaagatgaaatgcaggttcaagaatgtgaacctgagaaggtggaaatcagagagaggtgtggtacatyccccttccctcccttgcccctcccacatttaatgtactttggcaatagagttggccagttcagagcttttgtaattaaatgtttgcttttatctgttcct

SEQ ID NO: 48222 - DNA, 201 bp, Homo sapiens
ctcactctgtcacccaggctggagtgcagtggcttgatctcggctcactgcagtctctgccttctgggttgaaggttgaagcaattctccagtctcagccyctcaagtagctgcgttacaggtgcccgccaccatgcccagctaatttttgtatttttagtagagacctggtttcaccatgttggccaggctggtctcaaa

SEQ ID NO: 48223 - DNA, 201 bp, Homo sapiens
tttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggcca

SEQ ID NO: 48224 - DNA, 201 bp, Homo sapiens
gatgacgagtgtgatgtcattgagtatcctcttgaagaagaggaggaggaggaggatgaagacactcggggaatggcagaagggcaccatgcagttaataytgaaggtttgaagtctgccagggtggaagatgaaatgcaggttcaagaatgtgaacctgagaaggtggaaatcagagagaggtgtggtacattccccttc

SEQ ID NO: 48225 - DNA, 201 bp, Homo sapiens
cttctctctgtttctcttccctggatactatggtatcctcctcctttgtggtttcttttggtctctggtttttgtgtgttttttgtttgtttgtttgtttktttttgaaatggagtttcactcttgtcgccctggctggagtgcagtggcgcgatcttggctcgcggcagcctacgccacccagtttgaagtgattctcct

SEQ ID NO: 48226 - DNA, 201 bp, Homo sapiens
aggttgggctggtttccctgctcccctggctgccgtttctccattagaactggaattggggatttcacaaggacctcttggaaaacttcacagttagtttwaaaaaaaaatgcatttgtcacccagaggatcaatatttttctaaaatttctaaaataaaggatcagtttgtttctgaaatttggttacctgaagccattg

SEQ ID NO: 48227 - DNA, 201 bp, Homo sapiens
tgatttctgacagaatatgtatacatacgtgtgtgtgtgtgtgtgtgtgtgtgtgtgtgtgtatttatttgagacagagtcttgctctgtggcccaggccraagtgaagtgcagtggcatgatcttggctcactgcaacttccacctccctggttcaagcgattctcatgcctcagcctcctgagtagctgggattgctgg

SEQ ID NO: 48228 - DNA, 201 bp, Homo sapiens
tggaggtgggaggatcacctcagcctggggaggttaaggctgtagtgagctgtgatcataccactgcactccagcctgcttggtagagtgagaccctgtckcaaaaaaataaataaaaattaaaaaggaagtgaccagttcattcatagttattaacacttctgcttgtgtgtcacttctactcgccttcacttggctgaa

SEQ ID NO: 48229 - DNA, 201 bp, Homo sapiens
caggcaggggtagtccatctgaatggaaactcctttttggggggcacacatcatttttattttattttatatttctgagacagagtctcgctctgtcgccygggctggagtgtgtgatctcggctctctgcagcctccacctcctgggttcaggcgattctcctgcatcagcctcccgattagctgggattacaggtgcat

SEQ ID NO: 48230 - DNA, 201 bp, Homo sapiens
atagatcgcttgagcccaggaattcaagactagtctgggcaacatggcaaaaccccatctctacaaaaaatacaaaaattagccgtgtgtggtagcacgcmcctgtagtcccggctacctgggaggtggaggtgggaggatcacctcagcctggggaggttaaggctgtagtgagctgtgatcataccactgcactccagc

SEQ ID NO: 48231 - DNA, 201 bp, Homo sapiens
gggatgctttctgggctctagacttgcctagtccataaatcactctagtcgaggttctgcctcagcgaaagtgagttctgggtgtgtgtgtgtgtgtgtgygcgtgtgcgtgcgcgctcggcagggaatgttagaaggaaaaaagactaggcttaaaagtaattttttaaaatatccaaactggccccaaagaaagaaacc

SEQ ID NO: 48232 - DNA, 201 bp, Homo sapiens
cagctgtcccactgtgcacgccctccccagttcaccttttctctgagggagactcattggtgctcaggtatgcatgtgactcttcacacacacacacacamtcacactcacactcttgccaccatgacttccatttaatgttcaagaattcttctctcacagctctgtaaaatatttgagaaggacaaaaactttcaaaaa

SEQ ID NO: 48233 - DNA, 201 bp, Homo sapiens
actcaggaggcagaggttgcggtgagctgagatcgtgccattgcactccagcctgggcggtcaacaagaacaaaactccgtctcaaaaaaaaaaaaaaaaagaaaagaaaaccagctgtggcctggtagccggcctccctgtctctgaatattcacatccttgtacagtcccttcccatattgtaccagggttggtttgtg

SEQ ID NO: 48234 - DNA, 201 bp, Homo sapiens
acacgcatttgatgtatgaatttgtatcgctgactcttcagacgcagtagtcctcccttatccaaggtccaaatatatgaaacagaaaattccagaaatamttcataaatttcaagttgtccgtgttctgagtagcatgatgaaatcttagccatcctgctctgcctgccggggtgtgaatcatctttttgtccagagtat

SEQ ID NO: 48235 - DNA, 201 bp, Homo sapiens
tttcaccatgttggccaggatggtctcgatctcttgaccttgtgatctgcccacctcggcctcccaaagttctgggattataggtgtgagccagtgtgccrgccaagaattaatttcaacattagactcagccagagttaatgaagaagctttccccacatgatggctcctcacaagaaatactatctatttataatattc

SEQ ID NO: 48236 - DNA, 201 bp, Homo sapiens
tccacagttcactctgagtgggaaggtgacttcccaggacagccggacatagcactgctgagcccagctggccttggagctgtggacacctgttccctgtwctcagccagagctctcctggctcgggctcacagctgcttgttgcctgtggtgggccaagatcctatgtcacagggtacacatctgcctgaggtcacttat

SEQ ID NO: 48237 - DNA, 201 bp, Homo sapiens
atgggcaccccaatcagtgattcagggagaggaccatattttaaacagcaggcaatgactcatttactgagtgttttctgtgtgtcaggcactgtactacrcactttgttcatctataagtggaagaatgcttgtttttcaagaacaaagggaataataagaataaaagtgaaggccaggcgcactggctcacgcctgtaa

SEQ ID NO: 48238 - DNA, 201 bp, Homo sapiens
ttttgtatttttagtagagacagggtttcaccatgttggccaggatggtctcgatctcttgaccttgtgatctgcccacctcggcctcccaaagttctgggattataggtgtgagccagtgtgccagccaagaattaatttcaacattagactcagccagagttaatgaagaagctttccccacatgatggctcctcacaa

SEQ ID NO: 48239 - DNA, 201 bp, Homo sapiens
taagaaattttaaactttatctcaagagttgtgggaaatcactggcaagttttaagttggtaggtgaagtgctggctggaggaatccctccagcttgggtmtgtgaggatggcctgagaacggaggcacctgcagtaatcccccagtgagagacactgtagcctgagctgaccttggggctagaaaaaggggacaaatggc

SEQ ID NO: 48240 - DNA, 201 bp, Homo sapiens
tgaggatggcctgagaacggaggcacctgcagtaatcccccagtgagagacactgtagcctgagctgaccttggggctagaaaaaggggacaaatggcggytgaggaggagaatctctgtgagttgattgaatggggagaggcaaacatcaagcccagtgcccagacttctgggaggatctggctgctactcagtatggcg

SEQ ID NO: 48241 - DNA, 201 bp, Homo sapiens
tccctatgttttcttctaagaagttatgcttttattttttatacttaggttgttaattcattttgagttaatttttcatatggtatggggtaggggcccarctttattcttttgtatgtagatatctagttttcccagcaccacttgctgaagagacagtatttccccatttgaatggtctttgtacccttgttaaaaatc

SEQ ID NO: 48242 - DNA, 201 bp, Homo sapiens
aatgaaagatgtatcgataaataaaagacctgttaaaaatatgtaactttaccaccattaaataaccactgtttatattcttccggagattttttttttttaggtgtgtatgcctaaataagattcttaaatacagaaatgcaccctgcttttctcagttgaaaattataaacctctctgcttatcagtagtcactgctgt

SEQ ID NO: 48243 - DNA, 201 bp, Homo sapiens
cagtgcctcgtactgcagaccaggacactagcacagatttggaacaggtgcaccagttcaccaacaccgagacggccaccctcatagagtcctgcaccaayacttgtctaagcactttggacaagcagaccagcacccagactgtggagacgcggacagtagctgtaggagaaggccgtgtcaaggacatcaactcctcca

SEQ ID NO: 48244 - DNA, 201 bp, Homo sapiens
attttagggataatggaatattaggggcataatggggaaagttgaaaaattatggtcagtggagagatagttaaaaaaaaagtactggaatagaagttagragacttcacctagtacctcagtgatctggagtcatcatggcaccatgctgggcctcagtttcctcgatctgtaaaatgaggatgcttgatccattgtttc

SEQ ID NO: 48245 - DNA, 201 bp, Homo sapiens
tgaggatgtttctttgtgagctcagtgctagacaggcacaggagcagtattaggatggaaacatttcttaattgcttgaggagtgaggaaaaaaacggcastctgcaataaccctcttgtttccaaataccaaagcagctgttgggctgtgctcctgtctaggtaccttttcctcaggagttaagtgccacatgatgatat

SEQ ID NO: 48246 - DNA, 201 bp, Homo sapiens
gtgtcctttattctgaataccattttgatctgtgatccactgatggaagtcaatgatgttgaactaagaaaatacataggttactagctatgaaccattccttcattagtgcacttgcttggtaatgggttaatttgaattgggaatgaatcttagtccacaaactagaggtgcagagaatattgcagtttgctaaataga

SEQ ID NO: 48247 - DNA, 201 bp, Homo sapiens
cggcgcgtctggagttgttcgttcctccggtctggagttgttcattcctcccggtgggttcgtggtctcgctggcctcaggagtgaagctgcagaccttcstggtgttacagctcataaaggcagcgcggacccaaagagtgagcagcagcaagatttattgcaaagagtgaaagaacaaagcttccacactgtgggaggg

SEQ ID NO: 48248 - DNA, 201 bp, Homo sapiens
tggctcgggctcacagctgcttgttgcctgtggtgggccaagatcctatgtcacagggtacacatctgcctgaggtcacttattaacccccagtttttttsctttcctggtctctagggcacccctaggcttggaaggaagacgtctcctggccccacccaccgaggttcatttgattgattgtatgcaaatagcccttta

SEQ ID NO: 48249 - DNA, 201 bp, Homo sapiens
cagtgagaaaaggtggtgaggatagcagggattaagtaagtcgcgggcattttatttttatcttaaagaaaatgttaaaatggttgacgttttctagctcracactcccacccccacctcacccattgattgatggtttgctttcgaaatcctgagtgaaaagacaggaattacttcattgtgctgagagtgactgatgtc

SEQ ID NO: 48250 - DNA, 201 bp, Homo sapiens
ggattttgccatgttggccagcctggtcttgaactcctggcctcaagtgatccacccacctcggcctcccaaagtgctgggattataggcgtgagccaccrtgcccggccaacagtgtcttgttattttaccagtgatatgcttacagttcctaattttaggcttcctccttattttggttttattgttcagtttggggaa

SEQ ID NO: 48251 - DNA, 201 bp, Homo sapiens
ttgtttgtttttgaaatggagtttcactcttgtcgccctggctggagtgcagtggcgcgatcttggctcgcggcagcctacgccacccagtttgaagtgawtctccttcctcagcccctcaagtagctgggattacaggcaggcgccaacacacccagctaattatgtatttttggtagagatggggtttcactatgttgg

SEQ ID NO: 48252 - DNA, 201 bp, Homo sapiens
tgctcccagccaactcttgcttcttaaacccaaggaccctgatttctgacagaatatgtatacatacgtgtgtgtgtgtgtgtgtgtgtgtgtgtgtgtgkatttatttgagacagagtcttgctctgtggcccaggccaaagtgaagtgcagtggcatgatcttggctcactgcaacttccacctccctggttcaagcga

SEQ ID NO: 48253 - DNA, 201 bp, Homo sapiens
catcctcaggccttcacccttagaggtcccaaaaaagtttcccagaagaccgaacgagtagggatatttggggaaccttgccaattattggagggtgtttygttctgttacctttcggttgtctggaggtttgagaaacccaacatggcttgttctttccatcttatcttaaggatggcagcactgcgctctcaatcgccc

SEQ ID NO: 48254 - DNA, 201 bp, Homo sapiens
ggatctgtgcaacccactgggattgcgtgcttacacacagatgttacttgtagccttaaaccgaggtggtttagggttttaggatcacagtgccctctctragaggaaaggtaaaagatctttggcaaattgcagagtctctaaacacacactactgctgcttgcctggtcattcataattaattaattagaagaaaaaaa

SEQ ID NO: 48255 - DNA, 201 bp, Homo sapiens
cctttatatccatttaaatccctgaaatttaatggaaatcaagcagttaagtgaagcttttttcacccatatgtagtgtttcccctcttatttccagaagwtggatctgtgcaacccactgggattgcgtgcttacacacagatgttacttgtagccttaaaccgaggtggtttagggttttaggatcacagtgccctctc

SEQ ID NO: 48256 - DNA, 201 bp, Homo sapiens
gctggggttacacggtgactaaaaccagttcctactatagtgaaccttttccacccaaagtgaacacactgacccatcaaagtgagtagcttgtgacacarcatatgccagagcctgcagagtagcttgacttcttgaagcgttttcccatttctgcttagtctgtcccatcaacaccactctgctctcttctcccagttc

SEQ ID NO: 48257 - DNA, 201 bp, Homo sapiens
aacgttccatacgtaagcgtttgcaaacacttcgttcatgaatagctcactacctgcttcactttcctaaacacagctgagtgcctagattccaaaaatcrtttattctcaagagcaaccagtagaacaaccaccctgacttccaagccattgcatttcagccaccagttgcaaacaagatacgctgtggaagcttaccgt

SEQ ID NO: 48258 - DNA, 201 bp, Homo sapiens
ccgggtttcaccgtgttagtcaggatggtctcgatctcctgacctcgtggtccgcccatcttggcctcccaaagtgctgggatttacaggcatgacccacygcgcctggcctcaaaaacttaacacaatgtaaatgctatataaatagttgttatactgtattgttttgtattacatattttttaaatattttcactctgc

SEQ ID NO: 48259 - DNA, 201 bp, Homo sapiens
ccattctcctgcctcaccctccccagtagctgggactaccggcgtccaccacaacgcccggctaatttttttgtatttttagtagagaccgggtttcaccrtgttagtcaggatggtctcgatctcctgacctcgtggtccgcccatcttggcctcccaaagtgctgggatttacaggcatgacccaccgcgcctggcctc

SEQ ID NO: 48260 - DNA, 201 bp, Homo sapiens
ctcttaagaagaagaaaccaatgtagaactcaagattttagcagacttacttggtcttgaacaagtatcacaaataccttaaaccctgacttcatgggggkgggggcaaggtatagaggaggaagggttctggatcctctctggggggccagggttgtgttcttctccagacaacagagggtgatccagtaccactagtag

SEQ ID NO: 48261 - DNA, 201 bp, Homo sapiens
agtggcgtgatctcggctcactgcaagctccgcctcccgggttcgggccattctcctgcctcaccctccccagtagctgggactaccggcgtccaccacarcgcccggctaatttttttgtatttttagtagagaccgggtttcaccgtgttagtcaggatggtctcgatctcctgacctcgtggtccgcccatcttggcc

SEQ ID NO: 48262 - DNA, 201 bp, Homo sapiens
tcatacactcttaagaagaagaaaccaatgtagaactcaagattttagcagacttacttggtcttgaacaagtatcacaaataccttaaaccctgacttcrtgggggtgggggcaaggtatagaggaggaagggttctggatcctctctggggggccagggttgtgttcttctccagacaacagagggtgatccagtacca

SEQ ID NO: 48263 - DNA, 201 bp, Homo sapiens
cctggagtgcagtggcgtgatctcggctcactgcaagctccgcctcccgggttcgggccattctcctgcctcaccctccccagtagctgggactaccggcrtccaccacaacgcccggctaatttttttgtatttttagtagagaccgggtttcaccgtgttagtcaggatggtctcgatctcctgacctcgtggtccgcc

SEQ ID NO: 48264 - DNA, 201 bp, Homo sapiens
  misc_feature (1)...(201): n = A,T,C or G, or insertion/deletion polymorphism (see Tables 1-2)
taaagcaccgtctttgcacagtgtgttagagagcactgtgccctgaggacttcgggagagctgcagaatgagtgttcagaatagtcggcactcacctttgncctcatgttgtgagatggagatattttaacctggccataatatgctttaaaagttggggggtgtttgtctgcttttgcttttatttccttcctgtgctgg

SEQ ID NO: 48265 - DNA, 201 bp, Homo sapiens
aggtgctctgggtggcttaaagcaccgtctttgcacagtgtgttagagagcactgtgccctgaggacttcgggagagctgcagaatgagtgttcagaatartcggcactcacctttgtcctcatgttgtgagatggagatattttaacctggccataatatgctttaaaagttggggggtgtttgtctgcttttgctttta

SEQ ID NO: 48266 - DNA, 201 bp, Homo sapiens
gtaatcccagttacttgggaagctgaggtaggaagattgcttgagcctgggacagcaaaactacagtgagccgtgattgcaccactgcactccagcctggrcaacagagtgagaccttgtctcaaaaaaaaaaaaaaaaaaaaaaaacttaaaaatggcaaaaaaaaatctctaaatgttattccagaatgtcataaaggc

SEQ ID NO: 48267 - DNA, 201 bp, Homo sapiens
atcacatcactgcattgtatgattccagggctctcttgcccatggctcgtccatgaactaggaagtgatcatagttcctgttcttgttttatgaaaacaawagtataccttcccccaacctaggcaggccattcaggacgactaccctggaggtgctctgggtggcttaaagcaccgtctttgcacagtgtgttagagagc

SEQ ID NO: 48268 - DNA, 201 bp, Homo sapiens
gggaggctgaggcaggcaggcagatagcttgagcccaagagttccagaccagcctgggcaacatggtgaaaccctgtctctacaaatacaaagccgggtgyggtggcacacacgtgtaatcccagttacttgggaagctgaggtaggaagattgcttgagcctgggacagcaaaactacagtgagccgtgattgcaccact

SEQ ID NO: 48269 - DNA, 201 bp, Homo sapiens
caactttggaaatcagagttccactgacccccctcattttaagggtatgaatcacatcactgcattgtatgattccagggctctcttgcccatggctcgtscatgaactaggaagtgatcatagttcctgttcttgttttatgaaaacaaaagtataccttcccccaacctaggcaggccattcaggacgactaccctgga

SEQ ID NO: 48270 - DNA, 201 bp, Homo sapiens
ttaaaaacttagaacaggttgggcacagtggctcacacccataatgccaatactttgggaggctgaggcaggcaggcagatagcttgagcccaagagttcsagaccagcctgggcaacatggtgaaaccctgtctctacaaatacaaagccgggtgcggtggcacacacgtgtaatcccagttacttgggaagctgaggta

SEQ ID NO: 48271 - DNA, 201 bp, Homo sapiens
agggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttct

SEQ ID NO: 48272 - DNA, 201 bp, Homo sapiens
gttgcttgctgtgtgacctttggcacagttactaaacctctctgtgtgtcaatttcccatctataaacagggataataaaagcatctcctttattgggtayttgtgaggattgaatgagttaaaaccaactctgttggttgaggcagtcacctgtccagactcaagaacacttagaagggtggttggtatacagtaagttt

SEQ ID NO: 48273 - DNA, 201 bp, Homo sapiens
agggtctctcactctgctgtgcaggctggaatgcagtggcgtgatctcggctcaccgcaacctctgcctccctgttcaagtgattcttgtgcctcagcctsccaagtagctgggatcacaggcgtgtaccaccctacccagctaatttttgtagttgtagtagagatgggattttgccatgttggccagcctggtcttgaa

SEQ ID NO: 48274 - DNA, 201 bp, Homo sapiens
agggctcaggcgatcctcctaccttagcctccagagtagctgggactacaggcgcgcgccatcgcgcccagctgattttttttttttttttttttttttttggtgaaaacagaatttcactgtattgcccagaactcctggggtcaactgatctacctgtctcggcctcccaaagtgtgaggattataggcctgagccact

SEQ ID NO: 48275 - DNA, 201 bp, Homo sapiens
ttcacccagcccccggagaggttttgaaaagcccctggctcatcagagcttgcttgtttcataaactcttaaggctttgttttaacctgtagccagcttcrccttataagctttcttgccccaagccttgagccagtcataatggcttaagcatcagatttcagacaggcgattagctctccagctaagccaagaaaggat

SEQ ID NO: 48276 - DNA, 201 bp, Homo sapiens
cctacaaatgggggacaccctgggttttgaagtcttgcctgtgtggttaatcagaacctcagaattcacccagcccccggagaggttttgaaaagcccctsgctcatcagagcttgcttgtttcataaactcttaaggctttgttttaacctgtagccagcttcgccttataagctttcttgccccaagccttgagccagt

SEQ ID NO: 48277 - DNA, 201 bp, Homo sapiens
atttattatgttgacatttaaaatcagaagtgtgatatctgtgaagttctgattaaacagatcaagtgaaaaggatgtatttcagaaaactgcataaaacyctaaagtacagtgtttaaaaataaaacgtcctccctgatagggattatgttggtaagttactttttttcttagtatggattatttcaaattaataaacat

SEQ ID NO: 48278 - DNA, 201 bp, Homo sapiens
gaaattctgtcttcatccactgtccaatctcttctgctctgttttgggaacttggaattgatgcagagaagaaagccaagcagatttatccttcctttctyttataagtgtgtttgttccctctttttggagccatgttagggtataactgcttccatcttacaggaaggaatttcaagcccctcctcttcaggctttcta

SEQ ID NO: 48279 - DNA, 201 bp, Homo sapiens
acacagtgctactgcactccagcctccatgacaaagtgagactccgtctcaaaaaaaaaaaaagaaaagttatttaaattaatgataacataaaatttgayaggaaaccagaagagaagaattactcaaaattccacactaggtcttatttttagtatttatttttcatgcttttcaggctaacaaacttaaacacagttt

SEQ ID NO: 48280 - DNA, 201 bp, Homo sapiens
agaagtcagccattccagccatggtgggggactacatagctgcttttgaggccatttccccagatgtcctccgctatgtcatcaacttggcagacggcaayggcaacacagccctccattacagcgtgtcccactccaacttcgagattgtgaagctgctgttagatgccggtatgttggctgcccttccaccctctcttc

SEQ ID NO: 48281 - DNA, 201 bp, Homo sapiens
gacgaaggttgcagtgtcccgacacagtgctactgcactccagcctccatgacaaagtgagactccgtctcaaaaaaaaaaaaagaaaagttatttaaatwaatgataacataaaatttgacaggaaaccagaagagaagaattactcaaaattccacactaggtcttatttttagtatttatttttcatgcttttcaggc

SEQ ID NO: 48282 - DNA, 201 bp, Homo sapiens
tgaaattagttccagacgggcttcccttttattttccctttccgtggttgaacagttgtatttgggattggggtgggaattgggttggctatacacgtacrgtctcccaacctagtgctgtgctgaggagttgaaggaggtgagtttggtctggataggaaggaagcagcataattcagtgtaggctagttaatttcttcc

SEQ ID NO: 48283 - DNA, 201 bp, Homo sapiens
gttgtattaacatcctcattaaacccagttaaatgacataaatggatgagcactgggaggtgactttttatgcctgctcttatcatctttatttttgctamtagttgccttccccaattgattatagcttttccctcatgctctttctttttttgcagcctggatatatattttttcagacagatacatatttatttatta

SEQ ID NO: 48284 - DNA, 201 bp, Homo sapiens
cttgctccctggatcacactgccagcgtttccttgaggcccaacttcggacatcctttacccaccctggacttttcctggggtggaggcatctgtgaggcrtacacttgcagacagaaagcagggctaattgcagtcagtcgtcatctttctacatatttcatttctatttatagaacagtaagatccagggagcagcatc

SEQ ID NO: 48285 - DNA, 201 bp, Homo sapiens
agataataatagctatcctaccttcttcacaaggtggttgtgcagggaaaaaaagaatagctgtaaaaacactttttaaaacacaaagtgctggtcatatrtcaggggatagcaccattccccttgttctcttgtccttgtcatgagccgctgatcaggaaacatcccaggtaccctcatgtcaggccctgctggacgcca

SEQ ID NO: 48286 - DNA, 201 bp, Homo sapiens
gtaggtttggggttttagatttgagaaagggaaaccatttagagtatctgtgtgggaaatgggccaaggaattagaaatgcctgccagagacctctgcagratgcaggaaggacccagataaaaacgtctgggctccaagtcgacagattctgtgaaccccttaggcatgctgaggatttccttgccagatgatgtaacta

SEQ ID NO: 48287 - DNA, 201 bp, Homo sapiens
caaaaaaaaatttttttaaattagccaggcatagtggtatgcacctgtagtcccagctactcaggaggctgaggtgggaggattgcttgagcccagtagtytgaggctgcagtgagttatgatggtaccactgcactccagcctgggtgacagagccagaccctatctctaaagcaaaaaacaaaaaacattttattatgg

SEQ ID NO: 48288 - DNA, 201 bp, Homo sapiens
agtgaaccaaagaggcaaaaatttctgccctcaaggattgtacattctagggacagttaaagtctcctgtgtacacggttgccagaagaaaaaatactaarcacgtgttcatcgtttatctaaaattcggtttaatggtgctccactttcgtgcgcggccctacctgtgtaccccttgcagattgcacccctgcccttcct

SEQ ID NO: 48289 - DNA, 201 bp, Homo sapiens
agtcccagctactagggaggctgaggcaggaggattgcttgaatccaggaggcggaggttgcagtgagccaagatcatgccactgcactccagcctgggcracagagcatgaccctgtctcaaaaaaaaaattagatatttgggttgaaataaaaatgattttcttcttgtgaccaatcgtaacttgttttttctcctttc

SEQ ID NO: 48290 - DNA, 201 bp, Homo sapiens
aatgctgtaatttgtaaaatgtattatgccacacttcagacatacaaaatgtgtgaaagttatataacaagcacctttgtacacactacttagcttaagamataaaccttattaatataggccagatatacatgagcacctactacgtgctgttttaggtactggggatacagcagtgaaccaaagaggcaaaaatttctg

SEQ ID NO: 48291 - DNA, 201 bp, Homo sapiens
ctcttatggtagaatggcctggtacctaatcacccttgttttctgaaaccttaactctgctatataatttaacatatggaaccacaatccactaaaacttscattgtttgaacaccttaccttatatttaaagacattttaattttttggtggccagcctactttaagatttcagattttatgtttagccatttatcttga

SEQ ID NO: 48292 - DNA, 201 bp, Homo sapiens
gttggccagttcagagcttttgtaattaaatgtttgcttttatctgttcctcagaggtatacacatcttgagatactaatatatacaagtgcagagtattrcaactcttagatctcttatggtagaatggcctggtacctaatcacccttgttttctgaaaccttaactctgctatataatttaacatatggaaccacaat

SEQ ID NO: 48293 - DNA, 201 bp, Homo sapiens
aatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccac

SEQ ID NO: 48294 - DNA, 201 bp, Homo sapiens
gaaatcagagagaggtgtggtacattccccttccctcccttgcccctcccacatttaatgtactttggcaatagagttggccagttcagagcttttgtaawtaaatgtttgcttttatctgttcctcagaggtatacacatcttgagatactaatatatacaagtgcagagtattgcaactcttagatctcttatggtaga

SEQ ID NO: 48295 - DNA, 201 bp, Homo sapiens
taatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttcca

SEQ ID NO: 48296 - DNA, 201 bp, Homo sapiens
atttctactaaaaatacggaaattagccgggtgtggtggtggcatgcacctgtaatcctgaccagccagctgagatcgtgccactgcacttcagcttgggygacagagcaagactccatctcaaaaaatgtgtatattatatatatatgacttcatagacacacattggtctatacaacaaaaacaaagcattaggaaatt

SEQ ID NO: 48297 - DNA, 201 bp, Homo sapiens
ctaatccagggaaaaattaaaactaccatagctgtttcatttagcacagagtcagataacttttcatgtgtgtgtgtgtgtgtgtgtgtgtgtgtgtgtgkgtatgtgtgtgtgtggtaatgtattttaataggatcacacaatacatggaattttattatctgcttttttcaattaaccatatattacaaacatttttcc

SEQ ID NO: 48298 - DNA, 201 bp, Homo sapiens
gagaatcacttgaacccgggaggtggaggttgcagtgagcagagatcgcgccactgcattccaggctgggcgacagagcgagactcaatctcaaaaaaaamaagagtgttctggcattcagtgattaactagtgagactttttggaggccgctgcaatattttctaagtaatgatgaatggacttggagaaggaaaaatga

SEQ ID NO: 48299 - DNA, 201 bp, Homo sapiens
gacccaaagatgcaattagagatgaacatgtatatactgatttagacaaagagaagtactttatgaaaatgtgacaaggaaaaggggcttgctagttaatkggtgaagaagtggtgaagaggataaggattagtctaacaagtttgtttgtaatatttccctcagactcttcccctccttgatgatgataatatttccttc

SEQ ID NO: 48300 - DNA, 201 bp, Homo sapiens
gagaggaccttgggccaaagtttattaagcttgactaggaagattctgggcacatctccatccaaataccttgacacatacttcattcacccctagcacakgcagcttgtcccttcttgtcttctgtttgccttcaaggttttacatggtggtatttacaagccgttatggagcaagagtgcaaacacacaaggctagcaa

SEQ ID NO: 48301 - DNA, 201 bp, Homo sapiens
tttacaaaccaaatattgtaattttagggataatggaatattaggggcataatggggaaagttgaaaaattatggtcagtggagagatagttaaaaaaaaagtactggaatagaagttaggagacttcacctagtacctcagtgatctggagtcatcatggcaccatgctgggcctcagtttcctcgatctgtaaaatgag

SEQ ID NO: 48302 - DNA, 201 bp, Homo sapiens
agtatggtaatgcagcattctcaccacatttgaatcatctgggggcactaataaaaaagcactgatgccttagcttcaatccccagagatttagatttaaytggttttggtttgaatcaaacattggaatgctagaggagcttcccagatgatcctaatgtgtagagaacataggcagtgaatagttgctaggagtgaggg

SEQ ID NO: 48303 - DNA, 201 bp, Homo sapiens
agcaatgacattgagtctaaatgctgttggccataaggaaaatagtgacattccctggctcagaggaaatgctggtaggaaagccatatggactagtatttataagtacaagctcaggggtcaaagatgctgaagttcaatgccttgtcctgtctcttactaattagtgatattggacatattgattaattgcataagtat

SEQ ID NO: 48304 - DNA, 201 bp, Homo sapiens
tgagaatgaccagagatcactttcatctccatcttggttttggtgggttttggacggcttctttaccacaacctgttttatcagcaaggtctttgtgacckgtatcttgtgctgacctgtctcatcctgtgactaagaatgcctaacctcctgggaatttagacttaaaataaaggtctcagccttattttatctagcccc

SEQ ID NO: 48305 - DNA, 201 bp, Homo sapiens
ccaacttcttctgatttcatgggtctagagtcagagtttgggcacaatggaaatgggatttctatatgtactgttgtttactgtttgctagtatttttcgraaggtatttgcaaaaaccaaaggggaaacagtatacttttttgtatttttttttctttttttgttttaaattttgtgattgaaatataagtcttattatg

SEQ ID NO: 48306 - DNA, 201 bp, Homo sapiens
acactttaattctcaacttagaatttatttctcccaacttcttctgatttcatgggtctagagtcagagtttgggcacaatggaaatgggatttctatatrtactgttgtttactgtttgctagtatttttcgaaaggtatttgcaaaaaccaaaggggaaacagtatacttttttgtatttttttttctttttttgtttt

SEQ ID NO: 48307 - DNA, 201 bp, Homo sapiens
agtccattcaaaactaccaggcatttaaatagaccttactttgaacttctaagtgcaggatctaaaaccactagtgaaatttctggagtcaattagcaaaycccttcatagaaatttctatcactgggtcttcgtgagcacaccttgcatctcctgaaatcccaattgccacctaggtatgaaacaacttcaagtgatgat

SEQ ID NO: 48308 - DNA, 201 bp, Homo sapiens
tttctgaattgacactttaattctcaacttagaatttatttctcccaacttcttctgatttcatgggtctagagtcagagtttgggcacaatggaaatggratttctatatgtactgttgtttactgtttgctagtatttttcgaaaggtatttgcaaaaaccaaaggggaaacagtatacttttttgtatttttttttct

SEQ ID NO: 48309 - DNA, 201 bp, Homo sapiens
gctaagccggagatgccattattttctttaacaagtgttacatgataccaattggttatatgataccgataaccagtttaagttagagtccattcaaaacyaccaggcatttaaatagaccttactttgaacttctaagtgcaggatctaaaaccactagtgaaatttctggagtcaattagcaaatcccttcatagaaat

SEQ ID NO: 48310 - DNA, 201 bp, Homo sapiens
cagatattattttggcattctgttgttaagaggtcatgtgggtttctgaattgacactttaattctcaacttagaatttatttctcccaacttcttctgayttcatgggtctagagtcagagtttgggcacaatggaaatgggatttctatatgtactgttgtttactgtttgctagtatttttcgaaaggtatttgcaaa

SEQ ID NO: 48311 - DNA, 201 bp, Homo sapiens
ggagaattaataggatgaaataggaagacatggggtgggggggggacaaaaagcacctaccgatctgttttccataaagtatgttttctcatgatttatgmtaagccggagatgccattattttctttaacaagtgttacatgataccaattggttatatgataccgataaccagtttaagttagagtccattcaaaacta

SEQ ID NO: 48312 - DNA, 201 bp, Homo sapiens
aggctggagtgcaatggcacgatctaggcactacaacctccacctccgggttcgagccattctcctgcctcagcctcccaagtagctgggactacaggcaycccccaccatgcgtggctaatttttgtatttttagtagagacggggtttcaccgtgttgaccaggctggtctcggactcttgacctcaggtgatccacct

SEQ ID NO: 48313 - DNA, 201 bp, Homo sapiens
acatgcctcattataccctcctccctttggaattcaggcacaactgaccagcattaacattaaaacagagatcttaggagtgacaaacagactctttatascaataagataacaaattccaacctgactctcctatagcatcacatgacagcagaccctaaaagaaaatgaagtattttaccctaaaatatatttcttcga

SEQ ID NO: 48314 - DNA, 201 bp, Homo sapiens
taaaattctaagccccctaaccaacggaatagatccctcctgtcagccaggggattccatagtaaacctgaaaaactagttcaggccatgatgggaaggargtgtcaaacatgcctcattataccctcctccctttggaattcaggcacaactgaccagcattaacattaaaacagagatcttaggagtgacaaacagact

SEQ ID NO: 48315 - DNA, 201 bp, Homo sapiens
gtgcaatctcagctcactgcaatctccgtctcccaggttcaagtggttctggtgcctcagcctcccgagtagctgggattacaggcgtgcaccaccagccytggctaatttttgtattttttagtagagaagaggttttgccatgttggccaggctggtctcaaactcctgacctcaggtgatctgcctgcgtcagcctcc

SEQ ID NO: 48316 - DNA, 201 bp, Homo sapiens
ggtggctcatgcctataatcccaacgctttgggaggtcaaggcgggcagatttcctgaggtcacaagttcaagaccagcctggccaacatggtaaaacccygtctctactaacaatacaaaaattagccaggcatggtggcaggtgcccataatcccagctactcgggaggctgaggcacaagaatctcttgaaccaagaa

SEQ ID NO: 48317 - DNA, 201 bp, Homo sapiens
ccaagatcgcaccactgcactgtagcctagcaacagagtaagactctgtctcgaaagaagaaaacttgaacggagacaaaaattaaaaataaggccaggcrtggtggctcatgcctataatcccaacgctttgggaggtcaaggcgggcagatttcctgaggtcacaagttcaagaccagcctggccaacatggtaaaacc

SEQ ID NO: 48318 - DNA, 201 bp, Homo sapiens
ttgcctgtagccccagctacttgggaggctgaggcaggagaatcgcttaaaccgggaaggcgcaggttgcagtgagccaagatcgcaccactgcactgtascctagcaacagagtaagactctgtctcgaaagaagaaaacttgaacggagacaaaaattaaaaataaggccaggcgtggtggctcatgcctataatccca

SEQ ID NO: 48319 - DNA, 201 bp, Homo sapiens
catggtggcacttgcctgtagccccagctacttgggaggctgaggcaggagaatcgcttaaaccgggaaggcgcaggttgcagtgagccaagatcgcaccrctgcactgtagcctagcaacagagtaagactctgtctcgaaagaagaaaacttgaacggagacaaaaattaaaaataaggccaggcgtggtggctcatgc

SEQ ID NO: 48320 - DNA, 201 bp, Homo sapiens
gtgggataaggccatggtgacatgcataatagatgcattcatacacattgcttcaatagagcattttcttggatggaagcatgggaaataacacatgggcrtatactcacgcttgttgttagctttcggggtcactgctgatatccttccttgttcagttaccctttgggacttgaactcctgcaagatcgttgaaaatct

SEQ ID NO: 48321 - DNA, 201 bp, Homo sapiens
ttccttaaactttattgctagctacaagtcctttttaaatagaatcaataggctgggcatggtggctcacgcctgtaatcccagcactttgggaggccgasgagggcggatcacctgaggtcaggagttcaaaaccagcctggccaacatggtgaaaccccatctctactaaaaatacaaaaaattagctgggtgtggtgg

SEQ ID NO: 48322 - DNA, 201 bp, Homo sapiens
tgggtgtggtggtacgcgcctgtaatcccagctacttaggagactgaggcaggagaatcacttgaacgtgggaggcagaggttgcagtgagcccagattgmaccactgcactccagcctgggcaacaaagtgagactccgtctcaaaaaaaaaaaaaaaaaaaatctaatactagccatgaggaaagataatcactctcag

SEQ ID NO: 48323 - DNA, 201 bp, Homo sapiens
attgaacctgacagatggaggttacagtgagccaagattgtgccactgcacttcagcctgtgtaacagagtgagactgtctcaaaaaataatgataatagkaagtttcctaaggcttccccagccatgcagaactgtgagtcaattaaaccttttttcttcataaattgctcagtctcaggtagttctttatagcagtgtg

SEQ ID NO: 48324 - DNA, 201 bp, Homo sapiens
taactctaaaatcatctttttccttacctttccctagttctagaacagcaaaatattttacttagattctatcattaattaatatactcgtttgaattttyctcttctaaaaaatgtaggccaggcatggtggctttacacctgtaatcccaggactttgggaggtcgaggcgggcggatcacctgaggtctggagtccga

SEQ ID NO: 48325 - DNA, 201 bp, Homo sapiens
tagtcagtgtagctggaaaagccacgcagcgggcaggcttgtcagaagcaatctgtttaaaaaaaaaaaaaaagagagagagaaaaaagggtccttttgartttacactgagttgctttcacagtagttagctttgaactgtggtgcaaacccatttaaacaatgagggaaatttcactaagtggcaagaaattctcaccc

SEQ ID NO: 48326 - DNA, 201 bp, Homo sapiens
tcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatttc

SEQ ID NO: 48327 - DNA, 201 bp, Homo sapiens
tggggcaggccgctgatttgtgtgatgtatcattagagggaataagcccattgatcttttctagtttccgttaaacttgaactgagaggccaggcacggtkgctcacgcctctaaccccagcactttgggaggctgaggcgggtggatcacctgaggtcaggagttcgagtccaacctggccaacatggtgaaaccgagtc

SEQ ID NO: 48328 - DNA, 201 bp, Homo sapiens
tttttgtcactacaaaagaaaaccccgtacccagtaatcagtaacacactattctctcctctctctcatccctgacaatcattaatctgctttcagtctcwgaatttacaattctagataccacatgtaaaataaatgttctcatacaatatgtgaccttttgtgtctggcttctttcacttagtatattcatccatgttg

SEQ ID NO: 48329 - DNA, 201 bp, Homo sapiens
cagtgcctctgtttccaagagaaagtcaggtgattaccccttcatcagggagattggagccatcctatccttctggtgtgtcaccagccagaaactaaggrtcagcagggagtggatggtttagaatctcctctctccaggtgaacacaatgctagtcagtgtagctggaaaagccacgcagcgggcaggcttgtcagaag

SEQ ID NO: 48330 - DNA, 201 bp, Homo sapiens
gaggccaggctaaccaacatggtaaaactcagtctctactaaaaatacaaaaattagccaggcatggttgtgcacacctgtagccccagctacttgggagkctgaggcaggagaatcgcttgaacccgggaggcggaggttgcagtgaactgagatcacgccacagccctcactccagcctgggtgacagagcaagactct

SEQ ID NO: 48331 - DNA, 201 bp, Homo sapiens
gtttaaataaaactgcgtttgtcagaaatgtatagacattcactcctattcttaaaagacagtgtttatccctaatgcctgccttttgattcagccagcartgactgtgcacacagaggttattgctctccaagttcaatgttgtggacctgaaccagtgcctctgtttccaagagaaagtcaggtgattaccccttcatc

SEQ ID NO: 48332 - DNA, 201 bp, Homo sapiens
tgaagataaatgccctgctttatctactttgcttaaaataagtcaaaggcacattaggcatttcatatttgcagttaggggacatcaagtcacatagtgtkaaacgttgtttggaccgctgaattcagtattgtgtgtatgtgtgttgaggaggaagttggagttgtaaaggaatcgtccaggtagcccccatgtcccaca

SEQ ID NO: 48333 - DNA, 201 bp, Homo sapiens
atagtgaaacccatctctattaaaaatacgaaaaaaaaaaaaaaaagaagccaggcgtggttttgtacgtctgtggtcccagctacttggggggctgaggygggaggattgattaagcctgggagacaggttgcggtgagcagagatcacgccactgcactccagcctgggtgacagagtgagatgccatatcaaaaaaaa

SEQ ID NO: 48334 - DNA, 201 bp, Homo sapiens
cagggtttggcttagggttttgtggttgttagcttttaaaagcatacttagttgaataattccagaaactgggcttctttcctttgccccttcatttgccmctccctctctggtcttcccagtctccacttttttttttgtttaaataaaactgcgtttgtcagaaatgtatagacattcactcctattcttaaaagacag

SEQ ID NO: 48335 - DNA, 201 bp, Homo sapiens
tttaaaaattttaagttgtatttaaacaaagagaacctatggattaaaagactttaaaataatagcaaccaatggaaatacatgactggaattctgatgcraacaccctattaaagaaattttttagagactattggagattgggcacagtagctcatgcctgtaattccagtactttcagaggccaaggtgggtggatag

SEQ ID NO: 48336 - DNA, 201 bp, Homo sapiens
tgttctgtatctctgttacagaggtggttacacaggcgtatacatttaccaaattccatccgacttacacttaaaatcagtgcattttcgtggggcatgaycacaagcacctgggtcctgtgtcctagctactccaaaggccaaggtgggaggattgcttgagcccaggagttcaaggctacagttagctatgatcacatt

SEQ ID NO: 48337 - DNA, 201 bp, Homo sapiens
atgttctgtatctctgttacagaggtggttacacaggcgtatacatttaccaaattccatccgacttacacttaaaatcagtgcattttcgtggggcatgrtcacaagcacctgggtcctgtgtcctagctactccaaaggccaaggtgggaggattgcttgagcccaggagttcaaggctacagttagctatgatcacat

SEQ ID NO: 48338 - DNA, 201 bp, Homo sapiens
cccaggagtttgagaccagcctgggcaacatagcgagaccccttctctacaaaaaaattagaaaattatccaggcctggtggcacacacctgtaatcccasctacttgggaggctgaggtggcaggatcgcttgagcctaggaggttgaggctgcagtgagccatgattgtgttactgcactccagcctgggtgacagaca

SEQ ID NO: 48339 - DNA, 201 bp, Homo sapiens
ctgggtgacactatctggaaggggtgggaggaaaggcttaccaggttgttagaaatgttctgtatctctgttacagaggtggttacacaggcgtatacatytaccaaattccatccgacttacacttaaaatcagtgcattttcgtggggcatgatcacaagcacctgggtcctgtgtcctagctactccaaaggccaagg

SEQ ID NO: 48340 - DNA, 201 bp, Homo sapiens
agtctgtactatgccttggcctttttccctgtgacaatttagggatctttaaagaaaatattttgaaatgttttctcttgatcagggtgcttgtggttagrtattgcatacactgcttttatttgcagaatgagctatttttctaccatgtgatcctttgttagaaatgaacatgattgtggctggccgcagtggctcacg

SEQ ID NO: 48341 - DNA, 201 bp, Homo sapiens
tgctgaccatctcattgaggagacagggcatatttgaatctggaccgtaagtgctacaggacaatgatggggaaaaaagacatctctgtggaatggttggmatggtatcatagaaaaaagactagagaagatagaatttgggccaagccttgaaaagagtatgggtcgaattcagctggtgaaggatggcgaatttccaga

SEQ ID NO: 48342 - DNA, 201 bp, Homo sapiens
gaagaagacgaaagtagaagcaagaagaccaattaggaggttccagggacctgcctaactaaggtcagttagccggtgattgcccaagccaagactcaaastcatttttatgaaggccgcacaccctcatctcctcagcagttgttaaacaatatttgataatggtgttcatgtcaacctggcacatgtctagaagattct

SEQ ID NO: 48343 - DNA, 201 bp, Homo sapiens
tgactttgaccctgaatgtgtaaattatctttgcagcaataagaacttgaagtagctttgatagctaatcatagtatgataactcagccagaagaattcastaagagcagtttgtgtgtcttccatctaatgtaaaggttagtaatgtaagtcatattcttggtgcctttagacctagttatgcagagagacatcacattg

SEQ ID NO: 48344 - DNA, 201 bp, Homo sapiens
gaggtagaaagggagctctggcctgcttgtgtgattactgtgggagaatgaacaggaagaagacgaaagtagaagcaagaagaccaattaggaggttccarggacctgcctaactaaggtcagttagccggtgattgcccaagccaagactcaaagtcatttttatgaaggccgcacaccctcatctcctcagcagttgtt

SEQ ID NO: 48345 - DNA, 201 bp, Homo sapiens
tctggaccgtggcattgtgtaagaaattgccctactcatcccatccctggggcacattaatttggagatgatgttaaatgtgtcagagtgtggcacaaatytcaactggcagataaagcctagtattgaattgttttcagttcagaaacgtggctggctgactttgaccctgaatgtgtaaattatctttgcagcaataag

SEQ ID NO: 48346 - DNA, 201 bp, Homo sapiens
ctactgtcatctagtgtgtaaaggccagagatgctgctaaacactctgcagtgtccaggacaacccctgacaacaaagaattatccagccccaaacaccarttgtgctgagaaacgctggtgtctgtgaccctttcaggctcatgggaaaaggcggtcagagagggtgatagctggaggtgggtggacctgagaacaggct

SEQ ID NO: 48347 - DNA, 201 bp, Homo sapiens
tttggaatatagatctaagagtagatttatatcgggatttgaaagatgaatctttttcaaggatgtttttcctctggaccgtggcattgtgtaagaaattkccctactcatcccatccctggggcacattaatttggagatgatgttaaatgtgtcagagtgtggcacaaatttcaactggcagataaagcctagtattga

SEQ ID NO: 48348 - DNA, 201 bp, Homo sapiens
cttcagctcttatgtgccaccttagctgggtgcacttgtttagtgtgcagaatacaccttccatgcgtggtggcctaggatatatctgcacttctcaatckaaggcaatgttgcctcccagggaatatttggcaatatccgaagaaatttatgattgttatagctgaatcagagagggtaggtgctactgtcatctagtgt

SEQ ID NO: 48349 - DNA, 201 bp, Homo sapiens
cttcagagctcatttgtgggccttaccacctgtttcttacatatggggaaagagtctcttattctcttttggaatatagatctaagagtagatttatatcrggatttgaaagatgaatctttttcaaggatgtttttcctctggaccgtggcattgtgtaagaaattgccctactcatcccatccctggggcacattaatt

SEQ ID NO: 48350 - DNA, 201 bp, Homo sapiens
cagtccctggcttggtgagtggaccgtgcatgggacttcagctcttatgtgccaccttagctgggtgcacttgtttagtgtgcagaatacaccttccatgygtggtggcctaggatatatctgcacttctcaatcgaaggcaatgttgcctcccagggaatatttggcaatatccgaagaaatttatgattgttatagctg

SEQ ID NO: 48351 - DNA, 201 bp, Homo sapiens
gctctgtcataattaactaaagcagaaggagggagatccttttgtaaaatgcccaaagaaaagaaagccagatggaagtgaggagtaagagtaaccacagytgctttcctcttccatcagtctttaaaaactttttattttgaaataatgttagatttagagaaatgttgcaaaggtagtacggggctcccatacccttca

SEQ ID NO: 48352 - DNA, 201 bp, Homo sapiens
gccaaagctgatggatgatgcaaagtgaggacgtaacatatttcgctggggaaccagacagatatgcagagtaagcgctctgataggggaagtacgggctrttatgggcgcttcatactgggaacattaatgggaggtggaggtcgtagttgaagctgaaacctgttgggtgaggtggagttcgccaggtgaagtggtaga

SEQ ID NO: 48353 - DNA, 201 bp, Homo sapiens
tgaacccgggaggcggagcttgcagtgagccgagatcgcgccactgcactccagcctgggcgacagagcgagactccgtctcaaaaaaaaaaaatgaacaraggaccttaatagaaatttctcaatagaagacatacagatgaccaacagatacatgaaaagtgctcaatatcactaatcagggaaatgcaaattaaaacc

SEQ ID NO: 48354 - DNA, 201 bp, Homo sapiens
tagtccatggtacggatatatcataatttgtttatccattcatctgttgatagatttttgattttttccccaccttttaattcttatgaataaggctgctrtgaacatgggtgtgtaagtacttgagtccctgttttcagttcttttaggttcatacttagaggtgtaattgctgggttatatggcaagtctgtgtaacct

SEQ ID NO: 48355 - DNA, 201 bp, Homo sapiens
agaggaaaggctttcagctttttaccactgagtatgatattagctacgggcatgccgtatgtggcctttattatgtcgaggtccattctttatacctaatytgttgagagtttttatcatgaaaggatgttgaattctttcaaatgatttttatacatctattgagatgatcccttgatttttatcctcgattttgttaac

SEQ ID NO: 48356 - DNA, 201 bp, Homo sapiens
atttatttttaatgagatgaaattcacataatataacaataggcagtttaataattgacaattcagatgtatttagtacattcataatattgtgtagctgycacctctctctagttccaaaacatttttgtcactacaaaagaaaaccccgtacccagtaatcagtaacacactattctctcctctctctcatccctgaca

SEQ ID NO: 48357 - DNA, 201 bp, Homo sapiens
gacgttcaacttgtatgccaaattagtaaatattttttgagttcctacccacatccctgtgtatgggctctagaagcagccatggtttagtttcctcaccygtaagggagggtgtagaacttcttttaatgtacatcactgtaggttaagttcgggtagagaaaagactaaaggcaaccaaggctggctgtcctctgagcc

SEQ ID NO: 48358 - DNA, 201 bp, Homo sapiens
actgtcacgggaaagatttgtttaaacatattttttagtacagttttataagtccttatcaagtagggccagcccccagataaaaaccgttaagtatttakctgtaagccagaggttgagaataggaaacatttgaatctttaagaacttgagtccaacaaaaatactggctaacagcctgactgaggtgaaataaacctt

SEQ ID NO: 48359 - DNA, 201 bp, Homo sapiens
gaaaagaagcaatttattgatctgtaacacaggaatggactgtggccaaaccttttctggtttatacaatgcaccgacataagaatctgcatagcattaakaagaatgagcactcacaatttgaggccgcctgtcagcatgaataataactgagaaaaatcaatacacaatatacaactgttctctttgcacagacactgc

SEQ ID NO: 48360 - DNA, 201 bp, Homo sapiens
gcgatctactaaaacatgcatcagcatccttcagtctcccgaaataaatagacacaaagacaaattctttattttctctgttgatgtattttcctaaatcstttcgcaggagtggtttctttcttagctaggagaactaagccaccattgtaccacttaagatttactggtttgcactgtcctctgagggagaaaagaagc

SEQ ID NO: 48361 - DNA, 201 bp, Homo sapiens
gacaccaaataagaatgtagcagggaggaactcaagatgctgaccatctcattgaggagacagggcatatttgaatctggaccgtaagtgctacaggacartgatggggaaaaaagacatctctgtggaatggttggaatggtatcatagaaaaaagactagagaagatagaatttgggccaagccttgaaaagagtatgg

SEQ ID NO: 48362 - DNA, 201 bp, Homo sapiens
tggcaatataggtgaccaattccctctgacttgacaaaggagagccagtttggaatttaatgaggttcttttccttaccagttaagcctcagtagaatccycatgacctttggttgaattacatggacacttattaaaggctctcaatggtcccgcactgttctaagcactggacaggacaccaaataagaatgtagcagg

SEQ ID NO: 48363 - DNA, 201 bp, Homo sapiens
aaagaacattttctggcaatataggtgaccaattccctctgacttgacaaaggagagccagtttggaatttaatgaggttcttttccttaccagttaagcytcagtagaatcctcatgacctttggttgaattacatggacacttattaaaggctctcaatggtcccgcactgttctaagcactggacaggacaccaaata

SEQ ID NO: 48364 - DNA, 201 bp, Homo sapiens
ctctctctgtctctctgtctgtctgcctctcttgctctctctctctcatatctggacccatccagatcattgtatctacattttttaaagtctcaccctckattcaggtgattctaaagggtagctagggttgaaacgactgaattttgtttgttggcctctttgttctttggctttcctggctgcacgttttcttcgttt

SEQ ID NO: 48365 - DNA, 201 bp, Homo sapiens
cctcttaccttgggggcaaccccttccccaacaatgttccataagcaagaagaaattagagctgtcattagcctttcccatctccatagctcacacctcargattgaggtgtaccgaaacccaagggggtggggacattgaaactgcctttccaaaatcatgacagtaaaagaaacctgacatagctgactccgtcttact

SEQ ID NO: 48366 - DNA, 201 bp, Homo sapiens
gggggggctatatggcaaatacttactcttgctgcactttatgcaaataattagcccaagcataataagactaaaacttattttggaaataaattggtccyactatgattggtctttggtagaaatagaaaaccagagagagaaaaattatgtttcagaaaaactatagtaccccttttattgactccagctttgtccact

SEQ ID NO: 48367 - DNA, 201 bp, Homo sapiens
aataaattcttggctgggctcaagaggtttgtaaaaggtctaatttgagattccttatgaaaaatgtcagcaaagtcaatgtaaaagaaaaagggggggcyatatggcaaatacttactcttgctgcactttatgcaaataattagcccaagcataataagactaaaacttattttggaaataaattggtcctactatgat

SEQ ID NO: 48368 - DNA, 201 bp, Homo sapiens
cctggatatttttctcatattttggaaagttttctgttattatttattgagtaagcttttttctacccctcactcttgctcaactttctcttgaacaccartaattcttagatttggtcttttaaggtaattttctatatcttgtaggcaatctttgtataatatatttccattcattttactttttctcctctatgtaat

SEQ ID NO: 48369 - DNA, 201 bp, Homo sapiens
gatgcctgcaattggagacactagttgtattaccaaggctttgactggaatggcatgtttacagagtgctttggggaactgaagttgatctttagagccawtggaagccccttggaaaaactgacctccctcataccttgtcctttacagggttcctaacctgtggtaagtaaagaatgtcactttctgacaagctcagga

SEQ ID NO: 48370 - DNA, 201 bp, Homo sapiens
acaggtctcactggaataaaatcaagaagtcagcaggaccagttccttctgaaggttttggggagaatctgtttccttactgctgcagcttctagaggttscctgtattccttggcttgtgacccgtttcttcatcttcaaagccaccactggcaaatttagtcccttttacgcctgacatttcttctggctcctcttatg

SEQ ID NO: 48371 - DNA, 201 bp, Homo sapiens
aaaccatcctccagcctcagcccctcaaagtactgggattacaggtgtgagccactcccagcctgtaattactcctgtttttatccctattgttcagggarcatttactttctgtttagtatgaacatctaccattagtggcccagggctgttaattaaaccaccagcagttcctaaaaattcacatggatccaagttgat

SEQ ID NO: 48372 - DNA, 201 bp, Homo sapiens
aggagaaaagccatgtgtgtgttatggagtggtctgagtaagtatgatagacattaaaaaatacataaaaatagagtggtatgcatgtgctgaattatgtwtgtactaccaaacacacggaggaggagaacagaacagaaggtggaaagctatgagggatccagcgcttttctttgcagtggtggagagtcacgagagcaa

SEQ ID NO: 48373 - DNA, 201 bp, Homo sapiens
gtggtctgagtaagtatgatagacattaaaaaatacataaaaatagagtggtatgcatgtgctgaattatgtttgtactaccaaacacacggaggaggagwacagaacagaaggtggaaagctatgagggatccagcgcttttctttgcagtggtggagagtcacgagagcaaatagctagcctttacctaaagcaaaagg

SEQ ID NO: 48374 - DNA, 201 bp, Homo sapiens
ctaaggctatttatgttctctctaccatgctcgtcacaagcagtcttctgggtcctcacaagcagtctttattgtttatatttctattaacaggtctgttyaaggcaacgtaaacctttcctaccatgttcctcaaaattcttccaagctccttcactacccaattccaaaaccacttccacattttttggtatttgttat

SEQ ID NO: 48375 - DNA, 201 bp, Homo sapiens
gttccatcaccagtatgcgagaggtctcttttcccacacccttaacattggatagtggagtttaaaacaaacaaacaaaaaaaccttaccagttttatagrcagatgaacatcttttcatatgccatttatattcctttgtgagttttctgttcatatcctttgcccatttctccagaggggtatttgctatttttgttac

SEQ ID NO: 48376 - DNA, 201 bp, Homo sapiens
ccattaggtccccaaaccttgcctttgatgtatgtggcttcttgaggatcccctacatttgcatctgtttccttcccttatgcaaaggccctacgtcttcyctgggagaagagtcctcgggggctttcctgtgggagaaaggaaggatctattcctgcccacacttctttctctccagatagagaaatagctcacattttt

SEQ ID NO: 48377 - DNA, 201 bp, Homo sapiens
aaaagaatttttagaaaagttgccttttaatttaaatttcttgttttgtcctaataatcacattgaaatagccaaaacaaataatataaattaaaatgcarcgatggcccggcatggtggcacatgactgtagtcccagctactcaggaagctaaggccagcagattgcttgagcccaggagttcaagaccagttggggca

SEQ ID NO: 48378 - DNA, 201 bp, Homo sapiens
gtggagtttaaaacaaacaaacaaaaaaaccttaccagttttatagacagatgaacatcttttcatatgccatttatattcctttgtgagttttctgttcmtatcctttgcccatttctccagaggggtatttgctatttttgttactgacttgcagcaacgagattttaaagatttaaaatttttaaatgtcttttatta

SEQ ID NO: 48379 - DNA, 201 bp, Homo sapiens
ttttagaactttgaagactcatcacattgtcttccacagtggttgaactaatttatacttccaccaatactgtgtaaatgttcctttttctctgcaacctygccagcacctgttattttttgatttcttgataatagccattctgacaggtgcgagatggtatctccttgtggttgttatttgcgtttctctaatgatcgg

SEQ ID NO: 48380 - DNA, 201 bp, Homo sapiens
aataaatagtttgtgggagtgtgaagaatgagcctttagactgacccaacttgtggaaattcagaaaatgcagaaatgtacgttcttccagcttgtgaatsctgaacaatggaattgttagaagaacttttgaaacttgttctttttttgaaagtattattgtgctcggttggctacatgtgctttggtctcaaaaatttg

SEQ ID NO: 48381 - DNA, 201 bp, Homo sapiens
tttttcatctttcaaaacaaaagcgctatatctgttatacaacaactccccacccccctcttcccctggcagccattctactttctgtctctgtaattttkactattctaggtacctcataagtggaatcacacgctgtctgtctttttgtggctggcttattttacccagtgtaatgtcctcaagggtcatctatgttgt

SEQ ID NO: 48382 - DNA, 201 bp, Homo sapiens
aaatgtcttaagatacaatgaaatggagaatccctgagtgtttttttgatttcctaaactctgatccacaattatagatgtttctgaaggttcaaaaataytgaacgtgatttcagttgtttctagaatttaaaaaaattaataatttttaataatgacactttaaatgaggagaaggcttttaaaaccaaatataaaaat

SEQ ID NO: 48383 - DNA, 201 bp, Homo sapiens
actcatcacattgtcttccacagtggttgaactaatttatacttccaccaatactgtgtaaatgttcctttttctctgcaacctcgccagcacctgttatkttttgatttcttgataatagccattctgacaggtgcgagatggtatctccttgtggttgttatttgcgtttctctaatgatcggtaatgttgagcttttt

SEQ ID NO: 48384 - DNA, 201 bp, Homo sapiens
ttatgttgagataaggagaataatgtaagtcacccagactttttgtcattctgcatttttattcacagggatgaacagaagcttgcagattgggagaaagkggggggcagaaccagttgttttcaggtggacccaaataatgcatctgctttgataactgcctatctcgatttgcttggaaagggcatagagtaataaata

SEQ ID NO: 48385 - DNA, 201 bp, Homo sapiens
atctcaactcttgaagagctatttctgtgaaaaccaaacatgcagtcaaggcacattccacgtgtggctgatggggttatcatagttacaaatcatatttrtccacagtgataattatcttccttagcgttttgttctacttcagagctcatttgtgggccttaccacctgtttcttacatatggggaaagagtctcttat

SEQ ID NO: 48386 - DNA, 201 bp, Homo sapiens
tgtgagattgtttatattttgtaaaatgtcttaagatacaatgaaatggagaatccctgagtgtttttttgatttcctaaactctgatccacaattatagrtgtttctgaaggttcaaaaatactgaacgtgatttcagttgtttctagaatttaaaaaaattaataatttttaataatgacactttaaatgaggagaagg

SEQ ID NO: 48387 - DNA, 201 bp, Homo sapiens
ggtcatagctgtttttagaatctgttgctaatcactgtatatcgtagatattaagcctaggttaagagcattagtgtgggtacagagtttagatttgccartttgtgactttaggcatgtttaacctttctaagtctgtttttccatctgaagaatggacatagagaaaatttatcactgggctttttgtgggggacagat

SEQ ID NO: 48388 - DNA, 201 bp, Homo sapiens
tagagttctcatttcaaaatgggaaccagccctgccagagactaaagtgagccagaaatactctaaagtcttaaatagttaataagtgtgagattgtttayattttgtaaaatgtcttaagatacaatgaaatggagaatccctgagtgtttttttgatttcctaaactctgatccacaattatagatgtttctgaaggtt

SEQ ID NO: 48389 - DNA, 201 bp, Homo sapiens
cttatctcttggcaagaaagcaaagctggccattggggtataataaaccttgtgtacacagctgcaggagggaacagggaggtggctgtgcttggaggccrggtgttttgccgacgataatggggcatctctggcaccatgttgctggtcggaacagttttggagttggattttgtcctgcagtgatgtctttgaagagga

SEQ ID NO: 48390 - DNA, 201 bp, Homo sapiens
acagagtgagactgtctcaaaaaataatgataatagtaagtttcctaaggcttccccagccatgcagaactgtgagtcaattaaaccttttttcttcatarattgctcagtctcaggtagttctttatagcagtgtgaaaatggactaatgcaattgggcaatgtctgacagtttgcaaataccatctcatttgtttttaa

SEQ ID NO: 48391 - DNA, 201 bp, Homo sapiens
gcaggtttcattgcttaaggggacaatttatggcaataggcttatctccttgttttagctctttatgtttttctgcctttaataaaatgtgaagtcacaamgcaattaaatagtagtgtagttttcaggcaggaggtggagaaaggctaactagggggaaaaggccaacatgattgacagaggctggctggagatttacat

SEQ ID NO: 48392 - DNA, 201 bp, Homo sapiens
tggcgtgagcatcttatttgccctttaagccttaccctgggaataaaatatagcctttatcactgtttttggaatatcttggaagtgcgtaaaactgcttsagtttattatgtagaagtgcatttccagatttctggagtgtggatcgaagattttcataccagcagtagggtctcaaccttgtttttcttatctcttggc

SEQ ID NO: 48393 - DNA, 201 bp, Homo sapiens
aaaaaaaaaaaaaatctaatactagccatgaggaaagataatcactctcagatagtaaagcatttgcttagccatatgttaagctctgaattcagatgaargggcatctaaaacaggcagagagcatcaggaagggcttcctggaggagaaagtgcgtacactcagtctttaagagcacgtgggaggaaaaaccagtgaag

SEQ ID NO: 48394 - DNA, 201 bp, Homo sapiens
tagctaaaatgtgttcactgggttatgacaagtaactggacttctagggaatgggatggcaggtggggtgctatcagtttataaaattttttgtaaccttktctcttatttctgcttccctcccccagccatgggaacacaagataaatttggagtaggtgagggtggagagcaaagtgactccctgggctgtgcccttca

SEQ ID NO: 48395 - DNA, 201 bp, Homo sapiens
attagagagtccttactcaaagtatagtccttaagcactattatattgttttttctttcttttgtttgcttttctctccttgggtagtcctttgtgcaaarcgtaaatgcagaaactgctcattgacttgagccaaattgctcatgagcatgctggttcaataccaagaaagatgatcttggcgtcacccaccatagccta

SEQ ID NO: 48396 - DNA, 201 bp, Homo sapiens
ttatggtttcatctcacattttaaaatattttatctgtatgaaacttagtttgaaatgtgatttgagataggaattaaaattaatttctttcccaaatgartagccacctgcaatttttgtagttcttgtttattagagagtccttactcaaagtatagtccttaagcactattatattgttttttctttcttttgtttgc

SEQ ID NO: 48397 - DNA, 201 bp, Homo sapiens
gcactggcttgtcagggccacagctgctatgactctttctttctgtgagcaccccgatcccctagtccgctctttcactggatacctgtgtctaagtacgwtttttcatccatcgctcagccagaatctgccggtcagacctggcaagtatttatagaagaaatgaatcaatattacatctctaaccacaagattgcacag

SEQ ID NO: 48398 - DNA, 201 bp, Homo sapiens
ttgtattaattgcacaactccaatgctaaaggttggattgtgttagaggaatcggctctgtatttgcctctagagaaacacagtgttctctttgtatttayggattcctttttaccgtgtcacatttactttggtcctctatgtatttaaatgtttgaagtgccttagactcttgccatattttcaaaataaaattccatt

SEQ ID NO: 48399 - DNA, 201 bp, Homo sapiens
catagatcaggcagtggggatggttttgggatgaaactgttctacctcagatcatcaggcattagatcctcataaggaacgctcaacctagatccttcgcmcttgcagttcacaatagggtttgcactcttatgagaatctatgctgctaatgatctgacaggaggtggagcaggcagtgctgtgtgacctggttcctaac

SEQ ID NO: 48400 - DNA, 201 bp, Homo sapiens
tttgtatctattaatgtttgctttatatacttgggagctgaatttcagtccatcaaatgtattaatcagttctaagatttctgtttgattttttgaataawgtctctttgttaaatttctctgataaatttctgaatggagaattaccgttttgtttcttgttttctggttgttttgtaactcttctcctcctttcttcct

SEQ ID NO: 48401 - DNA, 201 bp, Homo sapiens
atttgacgtcctccactattattgtattataatctctctctctctttgtatctattaatgtttgctttatatacttgggagctgaatttcagtccatcaartgtattaatcagttctaagatttctgtttgattttttgaataatgtctctttgttaaatttctctgataaatttctgaatggagaattaccgttttgttt

SEQ ID NO: 48402 - DNA, 201 bp, Homo sapiens
ggagtgcagtggtgcaatctcagctcatcgcaaccttcacctcctgggttcaagtgattgtcctgcctcagcctcctgaatagctgggactacaggcacasgccaccacgcccggctaaatttttttttattattatttttagtagagacggggtttaaccttgttggccaggctggtctcgatcttctaacctcatgatc

SEQ ID NO: 48403 - DNA, 201 bp, Homo sapiens
gatgatctgttcattggtgaaaatggggtatttgacgtcctccactattattgtattataatctctctctctctttgtatctattaatgtttgctttatakacttgggagctgaatttcagtccatcaaatgtattaatcagttctaagatttctgtttgattttttgaataatgtctctttgttaaatttctctgataaa

SEQ ID NO: 48404 - DNA, 201 bp, Homo sapiens
attctcctgcctcagcctcccaagtagctgggattacaggtgtacaccaccacacccagctaatttttgtatttttaatgagacagggttttgccatgttrgtcaggctggtcccgaactcctgacatcagatgatccacccacctcagcctcccaaagtactgggattacaggcatgagccaccacacctagcccaaaat

SEQ ID NO: 48405 - DNA, 201 bp, Homo sapiens
gctgaggtctgagaggagagcgtagaaacaacatatttgtcctttctcctctatcaaagctacatgcttttcctcacaaagtagtatgtaccaaaaaagamgatggtccttcatgaataatctctactgcctgttccccaaaccatcatttgggcttaaagagtgaattcatgctcgagcccttttttttttttttttttt

SEQ ID NO: 48406 - DNA, 201 bp, Homo sapiens
tactgaattttgtatgttggctttgtatcctgcagctttactgaattcacttattacttctaatagttttttggtttttaaaaatagaagatcctgtcgtytacattcaaagcgaatttgacttctttctttccaatatgaacacctttatttttttttcttgactaactggccaggacttccgctttatgttgaatgaaa

SEQ ID NO: 48407 - DNA, 201 bp, Homo sapiens
tagatacaataaattagattactttctttctttttcagattgttcactattggtatatataaatgctactgaattttgtatgttggctttgtatcctgcarctttactgaattcacttattacttctaatagttttttggtttttaaaaatagaagatcctgtcgtttacattcaaagcgaatttgacttctttctttcca

SEQ ID NO: 48408 - DNA, 201 bp, Homo sapiens
tgagccaggtgcaatggtacacatccgtagtcccagctactctagaggctgaggcgggaggattgctagagcccagaaatttgagaccagcctgggcaacwtagtaagacctccatttctaaaaaaatatgaagtaaaaatcattattacttggattcctactctgtctcaagctataggctgtgaagatagtgtgaacaa

SEQ ID NO: 48409 - DNA, 201 bp, Homo sapiens
ctgcattggtgacagagtgcaaacctgggtgacagagcaaaaccctgtctcaaaaaaaaaaacaaaatattcctgggtattttacattctgtgtagatacrataaattagattactttctttctttttcagattgttcactattggtatatataaatgctactgaattttgtatgttggctttgtatcctgcagctttact

SEQ ID NO: 48410 - DNA, 201 bp, Homo sapiens
attgagcgtatccagaagctgctggcagaacagcagacactgctggctgagaactacagtgaactggcagaagctttcggggaacctcactcacagatggsctccctcaactctcagctcatcagcaccctgtcgtctatcaactctgtcatgaaatctgcaagcactgaagagctgaggaaccctgacttccagaaaacc

SEQ ID NO: 48411 - DNA, 201 bp, Homo sapiens
cccatccccgctacccttcccagcctccggtaaccactagtctactctctatcctcatgagattcagttttgtagctcccacatatgagtgagaacatgcracattgtctttctgtgctttgcttgtttcactgaacataatgacccccagtttcatccatcttgctccaaatgacaggatttaattctttttatggctgg

SEQ ID NO: 48412 - DNA, 201 bp, Homo sapiens
tgagggttgaaaaattacctattgagtacggtgtgcactatttgggtgatgtgtacactagaagctcaaagctcatcattacacaatatatccttgtaacwagcctgcacatgtactccctgaatctaacatacagttttaaaaaataatacaatcattatctcattacattgtttttaagcctgtgagttaaatatttgc

SEQ ID NO: 48413 - DNA, 201 bp, Homo sapiens
aatcactctcagatagtaaagcatttgcttagccatatgttaagctctgaattcagatgaaggggcatctaaaacaggcagagagcatcaggaagggcttyctggaggagaaagtgcgtacactcagtctttaagagcacgtgggaggaaaaaccagtgaagtcctcctgctgtagacagaatgatcagcctgggcaaagg

SEQ ID NO: 48414 - DNA, 201 bp, Homo sapiens
agtcaagtgggtttgtatactcaggagagggcagggagactgatggcttacattttcactcattgcttttgagttctttccatagctctaaaaatgcgcascttattagcgtggctctgggaaaacaacacatgacctgatcctacaatttaaaaaaataaaaatgaccttgcttttaagtttgaaatgcatagcccaggt

SEQ ID NO: 48415 - DNA, 201 bp, Homo sapiens
caggcatgagccagcgtgctctccaaaaaaaattttttttaattaagttttttgctctctgggtgcttatagtctggtacaaaagacaaaaaagtgttttsgtcttgttaaagttgggaaataaatcagggactcataagtgcctaatttatgttgatgtatgtaaacatacactagaaaacaggatattaaaaaaataat

SEQ ID NO: 48416 - DNA, 201 bp, Homo sapiens
gcctgagagcaaaggttagataacaaggggatgtaaaggaattgatctagataagttagtttacttaggcctcagaacctggcctttaatcatctgtgcgyaggactgctctttcccagggagcagcgggaagccgggggagggggaaccatgttaattacccacaagtgtgttgactcaaagactttgtcattacatcca

SEQ ID NO: 48417 - DNA, 201 bp, Homo sapiens
acaaagagtgttctggcggccaggcacggtggctcacacctgtaatcccagaactttgggaggccgaggtaggtaggtggatcacttgaggtcaggagttygtgaccagcctagccaacatagtaaaatcccgtctctactaaaaatacaaaaaacagctgggcgtggtggcgggcacttgtaatcccagctactcaggag

SEQ ID NO: 48418 - DNA, 201 bp, Homo sapiens
caaaaaagggtttggctgaaggcagccaaattctcttacctggagcctgagagcaaaggttagataacaaggggatgtaaaggaattgatctagataagtwagtttacttaggcctcagaacctggcctttaatcatctgtgcgtaggactgctctttcccagggagcagcgggaagccgggggagggggaaccatgttaa

SEQ ID NO: 48419 - DNA, 201 bp, Homo sapiens
gtacctgtcactgactcattcccaaactgaagcctaaccttcctttctgtgtgtttgcacacctcagggtagctgtccattcatcctttcttcctgaaggygtcccttctgaagtttccaggccgttctgtaccttctctctgtttctcttccctggatactatggtatcctcctcctttgtggtttcttttggtctctgg

SEQ ID NO: 48420 - DNA, 201 bp, Homo sapiens
gttactgacttgcagcaacgagattttaaagatttaaaatttttaaatgtcttttattataaaagtatgttagttgttttgataatttctttgaatttttmtactgcttttaaatgtatataaatatttaattttaggttgtcaaatctttttctttatggtttccatataggctaactaggaagtaagaatgccttggta

SEQ ID NO: 48421 - DNA, 201 bp, Homo sapiens
tcttgatttttttaaattcaattttggatatttactttcctcacactgtggaagatgaagatataactcttatgacttcccccaacacgtctcttctcctrctgtaatattaatatgatttttgtttgattaatatataatgtttatagtattatttagactggaaataattcacagccaagacatgtaatttaaatattt

SEQ ID NO: 48422 - DNA, 201 bp, Homo sapiens
aagtccctttctaacattaccattttctcatccaactccagtctacgctgcctcctctccatttcctcctttaccagacagtttagtgtgtctcaagttayattttatggtgctttagatatatatatgtatatttttgcttagagacttcatgcattattattagagacttcatgcagtatgtagtgactgtagaaaaat

SEQ ID NO: 48423 - DNA, 201 bp, Homo sapiens
ttcttgatttttttaaattcaattttggatatttactttcctcacactgtggaagatgaagatataactcttatgacttcccccaacacgtctcttctccygctgtaatattaatatgatttttgtttgattaatatataatgtttatagtattatttagactggaaataattcacagccaagacatgtaatttaaatatt

SEQ ID NO: 48424 - DNA, 201 bp, Homo sapiens
agaaatgacttgcccatgttcacatagctggtaaacccacactggttcagaacttaaaccagtgagataccaaagcccatatcagtgggcttttttacatrcttcttttccttaataaaatgcttatttcttttttctacagcatcattttaaatgacagcatagtattcagttatatggaaatgtaatggtttctctatc

SEQ ID NO: 48425 - DNA, 201 bp, Homo sapiens
gatcaatatttttctaaaatttctaaaataaaggatcagtttgtttctgaaatttggttacctgaagccattgacaaattagttgtttcttattcaggttrcttttaattgagttgtgcatgcaaacccacatgtatccctctctgcctctgaggagaatggggcctttcttggagaacacaaaagtaggaattctgattt

SEQ ID NO: 48426 - DNA, 201 bp, Homo sapiens
tgcatgtgttgttgtgttagctttctctatttttgcaacttgagtaacatttattacatgcttgtgctgtgccaagctaaataccaagcattttatatatrttaatttattctcataacccttggtacttttattatcctcatttacacacaggacaattgaagctcagagaaattagccaggcacagtggctcactcctg

SEQ ID NO: 48427 - DNA, 201 bp, Homo sapiens
cccctggctgccgtttctccattagaactggaattggggatttcacaaggacctcttggaaaacttcacagttagtttaaaaaaaaaatgcatttgtcacscagaggatcaatatttttctaaaatttctaaaataaaggatcagtttgtttctgaaatttggttacctgaagccattgacaaattagttgtttcttattc

SEQ ID NO: 48428 - DNA, 201 bp, Homo sapiens
aatgttaaaattgtactatattattttccaagtttttagaatatgtgcatgtgttgttgtgttagctttctctatttttgcaacttgagtaacatttattrcatgcttgtgctgtgccaagctaaataccaagcattttatatatattaatttattctcataacccttggtacttttattatcctcatttacacacaggac

SEQ ID NO: 48429 - DNA, 201 bp, Homo sapiens
cttcaggtaaaactctagcaacaagtcatctttgcccgctgtgcatcatccttgctgccattgagagtttggtcttaaaatggtacttgcaattagaacaygttcactttgtcacaaaatctgacagacattggacatacttagaattcatatctggcttcctgagacagctgtcagattgtctaccaatggtctacccat

SEQ ID NO: 48430 - DNA, 201 bp, Homo sapiens
gtggggaagggtgtgctgggtagaggggatagaatgagcaaagatagataagcttgaaaatttctcagtacgttgaggtttggggtggggaggaacctggraggtgctggattggggctaaattgttgacatttcgtgccacagagaagagcttttaggctttcttctttaaagtggagctcctggcacatcactttgcaa

SEQ ID NO: 48431 - DNA, 201 bp, Homo sapiens
aaacattgtgtagggcaaattaacaatatcagatcctcacattttctgtacatttgaccttgaccttatcccaggcaaatacttgatggtatagtgaaggrtatctttctcagcattacatatataatcaaaaataagaggtgacttaagtgcttcaagggaatttattaaaatggattattgatcagtcattaaaaatga

SEQ ID NO: 48432 - DNA, 201 bp, Homo sapiens
tcatcataaggactgagaggatacgggaccttattaagtcctcagtaagtagcagcaattttgcttttgtttttatgatgattacttccactcatgacttyacctgcatgttctttaatcttcaaaatagattagtgaagtagtgatgtttccattttagaaataaaatacgctggggaaacgaattgtaatacacatgac

SEQ ID NO: 48433 - DNA, 201 bp, Homo sapiens
ggtcattcagctacagggtgaccagcacaagaacatgtgccagttcctcttagagattggaatagctaaggacaaccagctaaatgttcatgggttttaastgctgtggctcgctgaagcttgaatgaggttttccttgcaatgagtagaatttcctttctgtcccttgtcacaagtttaaaaacctcacagctttgtata

SEQ ID NO: 48434 - DNA, 201 bp, Homo sapiens
ctgcaatgatactgtaattgagcatccagaatatggaggtcattcagctacagggtgaccagcacaagaacatgtgccagttcctcttagagattggaatrgctaaggacaaccagctaaatgttcatgggttttaagtgctgtggctcgctgaagcttgaatgaggttttccttgcaatgagtagaatttcctttctgtc

SEQ ID NO: 48435 - DNA, 201 bp, Homo sapiens
atagttcgtgcctataagcctcaaaaaggcaagaactgagtttattttgttcaccactgtagtgcccagcactgtgcctattacatgctgagttctcagtsaatatttttgaataaatgagtgaaacaaagttaggcttcctgggggatgttttctaaatccctaggtatcattttcttaaaatcagaggatattcttggc

SEQ ID NO: 48436 - DNA, 201 bp, Homo sapiens
ggctttttagaaatgttatagtagctctgatccacaaagtcctttgaggcccaagttccttctagtacatcgttcctccacccctagatatgaactcatgwttcaaagttacactagtgttctagtcatcacatctgcattccaggcagcaggatggaggaaggcacaaagaagaacataggtgaaaggattatttctgtg

SEQ ID NO: 48437 - DNA, 201 bp, Homo sapiens
gtagcatttagcataatacgtgtataactttttttgtttgtgcacatatagttcgtgcctataagcctcaaaaaggcaagaactgagtttattttgttcaycactgtagtgcccagcactgtgcctattacatgctgagttctcagtcaatatttttgaataaatgagtgaaacaaagttaggcttcctgggggatgtttt

SEQ ID NO: 48438 - DNA, 201 bp, Homo sapiens
agtctccactcatggcctgcattgttgatatatgcctttgtcactgatctcaattagtgttaagggtgtttggtagtcatctctcagctagactatatctsattttatttcttaaaaatttttcctcttactccttccactgaataggaccattttctgtagccaattaagctttcaataaatgtttatataatgaaagta

SEQ ID NO: 48439 - DNA, 201 bp, Homo sapiens
cctgtttttttctccttcgtagcatttagcataatacgtgtataactttttttgtttgtgcacatatagttcgtgcctataagcctcaaaaaggcaagaastgagtttattttgttcaccactgtagtgcccagcactgtgcctattacatgctgagttctcagtcaatatttttgaataaatgagtgaaacaaagttagg

SEQ ID NO: 48440 - DNA, 201 bp, Homo sapiens
caggactaagcaaatctcataacctagcctctgcttacctctcacttcagcccaacctactctttccctctcttaaaaactcagtagctgaaatatatggmgctctttctggccccgagcctccagaccttttaaagaaaaaaaaagattgtaattttgatgaagaccgcattgtcaatttttatttctatggctcttact

SEQ ID NO: 48441 - DNA, 201 bp, Homo sapiens
actattcctggaatatccagtgtcctttccccgtgatgataaacaaagcccagcgctgcctctctttaaagatagtaagaagcctatgcataaacaaaacwcttaaaaataagatcatttattttattttactcatccgcttaaacccatcaatgacttttaacttagaagaaaacctagtcttcctactatgaccaacag

SEQ ID NO: 48442 - DNA, 201 bp, Homo sapiens
aaggaagtcacatgttatttaacaaggtagattacttttttctttgtagtaggcaaggaaacagctatgcttcacttctaaataaaaaaaaaaaaaatttwaaaaacgttttttaaaaagaaaaacgtgactaagataactgtctcattcccaggcactttttaatctcatataaatttacatttagagacttaacagttt

SEQ ID NO: 48443 - DNA, 201 bp, Homo sapiens
gggggtggtataggctctccctaaattgcccaggctggaatgcagtggctcttcacaggtgcaatcatagctcactacagcctcgaactcctgtctcagcytcacaagtactgggactacaggcatgaaccaccatacccagttccattctgctttaaacagtggaaaaaatacatgtattttttaaatggaagggttggt

SEQ ID NO: 48444 - DNA, 201 bp, Homo sapiens
ttttgcgttttcagagtatattgtttaagttccccaggcctatcgtctacctttagctttccctgttggccaattcaggccctggtcagatgcgggtggakaggtacacaaagctggaaacagcgtgctgcccgcctttctctcctgcctccagagacacttgttggctgtcagggtcggtgttgtcttagcctcacaggc

SEQ ID NO: 48445 - DNA, 201 bp, Homo sapiens
acgtgcagcctggcttctggcctcttaacccatgcccagagtagaattggcaatacccaggagggacactgcactggggattgttaggtcatgccagttasgatgcagctggaaaggtgctgctgagtgggacgtgcagaggggaagactgcaggctctgtctgcctgagctcatctggtctgacacctgccgtgattcat

SEQ ID NO: 48446 - DNA, 201 bp, Homo sapiens
tcttctgtgcatgcatgattgatttgggctgtatttcagcaataacttttaaaatgagacagtggacattagagagcagcatagttggggttgcacttagragcccatggcattttggctgttttgagacagatttggggtaaagagttgctgcatcttgtagttggcactgaacactggagaagagggccactgtataaa

SEQ ID NO: 48447 - DNA, 201 bp, Homo sapiens
tgttgcatttttatttaaggaggcatgtggtgatgttagccctgtgatataggagaataagcagcaaaggttgggctggtttccctgctcccctggctgcygtttctccattagaactggaattggggatttcacaaggacctcttggaaaacttcacagttagtttaaaaaaaaaatgcatttgtcacccagaggatcaa

SEQ ID NO: 48448 - DNA, 201 bp, Homo sapiens
cttagaacagcatgttacttttgaagaaagtttggaaaataacagtccaagctcattctcttctgtgcatgcatgattgatttgggctgtatttcagcaayaacttttaaaatgagacagtggacattagagagcagcatagttggggttgcacttaggagcccatggcattttggctgttttgagacagatttggggtaa

SEQ ID NO: 48449 - DNA, 201 bp, Homo sapiens
agaatatgtatacatacgtgtgtgtgtgtgtgtgtgtgtgtgtgtgtgtgtatttatttgagacagagtcttgctctgtggcccaggccaaagtgaagtgyagtggcatgatcttggctcactgcaacttccacctccctggttcaagcgattctcatgcctcagcctcctgagtagctgggattgctgggatgcgccgcc

SEQ ID NO: 48450 - DNA, 201 bp, Homo sapiens
cgccaccacacctggctaatttttatatttttagtagagacggggttttgccatgttggccaggctggtctcaaactcctgccctcaggtaatccacccascttggcctcccaaagtgctgggattacaggcgtgagctactgctcccagccaactcttgcttcttaaacccaaggaccctgatttctgacagaatatgta

SEQ ID NO: 48451 - DNA, 201 bp, Homo sapiens
aagcagagggagccggctccggcctcggccagcccagagaggggctcccacagtgcagcggcgggctgaagggctcctcaagcacggccagagggggcgcygagagcaggcaagggctgacagcacgttgtcacctctcaatgcctatcttaaacagaccctttacatggcattggtggcaagtgagactggaaattcttt

SEQ ID NO: 48452 - DNA, 201 bp, Homo sapiens
tttcagcatatcccagtagaatacgggcttttccagggcaggaacctttagctggtttgctggttggtggtacatcaagctcctagaacggaactggaaaygcagaagacacttaaataggtatttgctgttaaatgagctgctgataaggatttactatgctgttcagaacccattatgtgaggaaatatatatttcagt

SEQ ID NO: 48453 - DNA, 201 bp, Homo sapiens
aggctgacactgctagggaacccagcgcaccctccacagctgctggctggagtgctaagcccctcactgcccaggggccggccgctccaagtgtggggccygccgagcccacacctacccagaactcctggcctacccagaactcctggcccgcgagcgttgtgtgcagccccagttcccacccacggctttccctccaca

SEQ ID NO: 48454 - DNA, 201 bp, Homo sapiens
gaggcaggctcagggacccaagtcttgtaggaaaccacaactccatgaagcctatatggagtttcttagcattgtctttaaatttttttttttttgttttragacagagtttcgctcttgttgcccaggctggagtgcaatggcatgatctcggctcaccgcaaactcccccttccaggttccagtgattcttctgcctca

SEQ ID NO: 48455 - DNA, 201 bp, Homo sapiens
gaattggagcgcagcgctggcaggctgacactgctagggaacccagcgcaccctccacagctgctggctggagtgctaagcccctcactgcccaggggccrgccgctccaagtgtggggcccgccgagcccacacctacccagaactcctggcctacccagaactcctggcccgcgagcgttgtgtgcagccccagttccc

SEQ ID NO: 48456 - DNA, 201 bp, Homo sapiens
gagttgttcattcctcccggtgggttcgtggtctcgctggcctcaggagtgaagctgcagaccttcgtggtgttacagctcataaaggcagcgcggacccraagagtgagcagcagcaagatttattgcaaagagtgaaagaacaaagcttccacactgtgggaggggacctgagcaggttgccactgctggctcaggcat

SEQ ID NO: 48457 - DNA, 201 bp, Homo sapiens
ggatgtagtatttcctgactataaaactccctaggaaaagtcctcaaagagccaccttgtttactttaggctagaggagcggagaaagggcagtgaccctrtatgacatacagtgaacaagagaggtggaactctggcaggaagtaaagggtagaggcaggctcagggacccaagtcttgtaggaaaccacaactccatga

SEQ ID NO: 48458 - DNA, 201 bp, Homo sapiens
gaagacctaggatgtagtatttcctgactataaaactccctaggaaaagtcctcaaagagccaccttgtttactttaggctagaggagcggagaaagggcrgtgaccctatatgacatacagtgaacaagagaggtggaactctggcaggaagtaaagggtagaggcaggctcagggacccaagtcttgtaggaaaccaca

SEQ ID NO: 48459 - DNA, 201 bp, Homo sapiens
ttccttctgatgttcgtacgtgttcagagtttcttcattctggtaggttcgtggtctcactggcttcaggagtgaagctgcagaccttcgcggtgagtgtwacagctcttaaggcggcgcgtctggagttgttcgttcctccggtctggagttgttcattcctcccggtgggttcgtggtctcgctggcctcaggagtgaa

SEQ ID NO: 48460 - DNA, 201 bp, Homo sapiens
aaagaaatattgatattgtcattccgtggtgtttaagtgtgtaaagaggaggagctgggaggaagatgaaggaagacctaggatgtagtatttcctgactrtaaaactccctaggaaaagtcctcaaagagccaccttgtttactttaggctagaggagcggagaaagggcagtgaccctatatgacatacagtgaacaag

SEQ ID NO: 48461 - DNA, 201 bp, Homo sapiens
attctccctatgttattccgttcacatgttgctgtgggttcattaaccccacacttagaaagtaatcatctttggctctaagaaaatctggaggttggacmtgaaaaacctcaggccagacagtgaatcagtcctggattgtgctgaattttctaatatgactccaccccatgaggcttcatgactgtcagcatctgctgt

SEQ ID NO: 48462 - DNA, 201 bp, Homo sapiens
tgattggtccattttacagagtgctgattggcccattttacagagagctgattgatccattttacagagtgctgattggtgtgttattacagagtgctgaytggtgcatttacaaacctttagctagacacagagtgctgactggtgtgtttacaaacctttagacacagagcgctgattggtgcgtttttacagagtgct

SEQ ID NO: 48463 - DNA, 201 bp, Homo sapiens
  misc_feature (1)...(201): n = A,T,C or G, or insertion/deletion polymorphism (see Tables 1-2)
atttttcctttgttcaaggttatttattatgttgacatttaaaatcagaagtgtgatatctgtgaagttctgattaaacagatcaagtgaaaaggatgtanttcagaaaactgcataaaaccctaaagtacagtgtttaaaaataaaacgtcctccctgatagggattatgttggtaagttactttttttcttagtatgga

SEQ ID NO: 48464 - DNA, 201 bp, Homo sapiens
aatgggatcaggctttttcagtcatttcccatttttaaaggacatctccatggcagatgcccctactccctcccggtgcctgaatatttgcctgtctagcrtgggtaggtgaacgtcagcagaactcttgaagaatcactaaagggatgtgcttgtcctagcaggagagcctgtgacaataaaaaagcagagaatgttctg

SEQ ID NO: 48465 - DNA, 201 bp, Homo sapiens
ctgctattctccaaggcattcctcaacagaatgggatcaggctttttcagtcatttcccatttttaaaggacatctccatggcagatgcccctactccctmccggtgcctgaatatttgcctgtctagcatgggtaggtgaacgtcagcagaactcttgaagaatcactaaagggatgtgcttgtcctagcaggagagcct

SEQ ID NO: 48466 - DNA, 201 bp, Homo sapiens
tgagctgttttacataccatagaattcacccattttaagtgtatggtttgataagttttagtatatgtggacagttgtatatccacaatccagttttagawcatacccataacactaaaaattctcttgaggtttatgttatcatttacttttgacagaaatgttttcttctgcttttgaaaaaaaaaaaattctgggcca

SEQ ID NO: 48467 - DNA, 201 bp, Homo sapiens
ttgctgcagtaatcctgttaagtgtaagaactgaaggttcaggttgaagtctcaaagttccaaagccaccatcccagggataaagactgtgctggtatackctcagccagcctggtaccacagaaggcttttgtctccagcaggttccttttctcactgggcgtcaccttttctggctactctccgcctgtcagaggccaa

SEQ ID NO: 48468 - DNA, 201 bp, Homo sapiens
tgggggtatggctggctggcctgctttccttctttcccactgttttcttgggaaggtctctacagacctcacctcttttaggtgtgaggagataaatagtscttattatcccttatttacagccttcatagagtctttgtagtaatctaagttaaggtcttaatgttcttatttagttctgtgtccccccaattcatttgg

SEQ ID NO: 48469 - DNA, 201 bp, Homo sapiens
agtaggccttaccggaggtccatgactacaggtactcagagaccagctgtatccaaagagttgtgtaagataggggcatctgctccctcccagtgctgttkcccagccccaccctgccctgttccccagttagtgtctttgctttcttgacctggatatctttcccatatctattaatataagcccttcttatccttcaag

SEQ ID NO: 48470 - DNA, 201 bp, Homo sapiens
ggctgaaattgagtggcttcttaccagaaattaggtatttgaataagagcagatcgtttttacttaaaagatgtaagttttgaaaatgaccacatgcagcrgttaacacactgatgactggacttacctgaagagtctctgattcagtagcccgttgtggggcccaagcatttctaataagtcctcaggtgatgctgacat

SEQ ID NO: 48471 - DNA, 201 bp, Homo sapiens
cagcttccaagtctgccccagggacaactgtttggcagtgtgaggggaaatggcagcatcacgtcataagtgcaatgattgttacctatgagcctatccgrtaagggatctgagtgggcccaagcatcacacacgtgctggagctgagtgttctctgaggaacatgctaggatgttacttgggtgctagaaaacagcagct

SEQ ID NO: 48472 - DNA, 201 bp, Homo sapiens
caaactgaggctgaaattgagtggcttcttaccagaaattaggtatttgaataagagcagatcgtttttacttaaaagatgtaagttttgaaaatgaccasatgcagcagttaacacactgatgactggacttacctgaagagtctctgattcagtagcccgttgtggggcccaagcatttctaataagtcctcaggtgat

SEQ ID NO: 48473 - DNA, 201 bp, Homo sapiens
ttctgaatttagtctcacaatatttggtttagttgataaatcccatccatcagctttgcaaataattttgtgaaaacattgattcagcttgtcctgcccarttttcccatccctgcccagtttactgagtgccttttccatttgcatccactgtccattaggccaaggcgtttgaagtgtttctgtacagcaggtacattt

SEQ ID NO: 48474 - DNA, 201 bp, Homo sapiens
cattggaaaagttttctctcagggatcttttctactttggacatgatctctgttaggcagaatcaaaagatagctgtgtggctttctgaatttagtctcamaatatttggtttagttgataaatcccatccatcagctttgcaaataattttgtgaaaacattgattcagcttgtcctgcccaattttcccatccctgccc

SEQ ID NO: 48475 - DNA, 201 bp, Homo sapiens
ttcagttcatctcctttgtgcagtttctgagaaaggtttgtatgggcttagaggaaaatgatcgtgactaaagctcacagtcaccgctttggctccttttytataaaaggtggtttgatttgatctggcatgaaaaatattatcataattctcaaattcacagaaacgataagttcttgctctttcctgaccaaaaaaaaa

SEQ ID NO: 48476 - DNA, 201 bp, Homo sapiens
atttgagtcctggcttaaagcggttgttcacatgttgaagtctgtatttaagctccgctcccaggctgggttgtgtcatcccgagcctccccttctccctycttgacccccagtggcccagggcagtttttactttaccgtttcttcctggctttttacctatacttttcggccagacacttcaaggggatctgattcgat

SEQ ID NO: 48477 - DNA, 201 bp, Homo sapiens
gaatttgcagtataaaatatactgccagtctatgcttgagttcataaatttgacagtgtctgttaacttcctgctaaggaagaagtggaatttatattccytcacacctctctttcctcttctctctgcctcctggtttttattagatatcttattatttttgccttattatttttagttgtcttcttttggttacctttc

SEQ ID NO: 48478 - DNA, 201 bp, Homo sapiens
ggttttgaaaagcccctggctcatcagagcttgcttgtttcataaactcttaaggctttgttttaacctgtagccagcttcgccttataagctttcttgcyccaagccttgagccagtcataatggcttaagcatcagatttcagacaggcgattagctctccagctaagccaagaaaggatgatttatcttccagtgagt

SEQ ID NO: 48479 - DNA, 201 bp, Homo sapiens
ctaggaagccagttcaatcctgagcccccgaggcaggcgttgggtcttctgtggagtccccagagacctgcaaccttctgaacacgcatcctcccctttcygccgaggactctgtcctgcagccgagccagggcgaatgcacggaggtcacaagggaggtgcccttggaggcgggaggtttctggccgccggggcgaccgt

SEQ ID NO: 48480 - DNA, 201 bp, Homo sapiens
ctgatctacctgtctcggcctcccaaagtgtgaggattataggcctgagccactgcgcctggccgacgagcacttttaaaatgcaggagtcttcctgcctstgatatctcatcccttatcaccatgcaaacaattctccttttcatagaagagtagacatttggggcggggtggtggtggtgggggattttagaaaatatc

SEQ ID NO: 48481 - DNA, 201 bp, Homo sapiens
gatgagataaagagggcttcatggcagctagtgagggccaattactggtctcctatgagaaaaggataagctatttgggtttagtaggagtttcagatgtrgagtaaattatatgtttcttcaatttccaaaaattgctgcttgggcttcatagagcatgaggggaaatttcatgtgacgatggagtcagggcagtggcaa

SEQ ID NO: 48482 - DNA, 201 bp, Homo sapiens
gaatttcactgtattgcccagaactcctggggtcaactgatctacctgtctcggcctcccaaagtgtgaggattataggcctgagccactgcgcctggccsacgagcacttttaaaatgcaggagtcttcctgcctctgatatctcatcccttatcaccatgcaaacaattctccttttcatagaagagtagacatttggg

SEQ ID NO: 48483 - DNA, 201 bp, Homo sapiens
tttcttctggcatgctttgtgagaaaatatttgagctggtgtaaattgtaattactggcagatatggaagagagtctgacttggagtattcatgatgctgmtatgctgctgcagtcagtcaagtgctgcgtgagttgatgtcattaccaaaggacagtctctataatcagagaataaagtataatttgtaaatgtggagga

SEQ ID NO: 48484 - DNA, 201 bp, Homo sapiens
actggcgtgaacctgggaggtggagcttgcagtgagccgagatcgctccactgcactccagcatgagtgacagagcgagactccatctcaaaaaaaaaaawttttttttgtagagacagggtctcgatatgttgcccaggctggtcttgaattcctggcctcaggcaatcctcctgccatggcctcccaaagcactgggat

SEQ ID NO: 48485 - DNA, 201 bp, Homo sapiens
atttttgagacagggtcacactctgtagcctggactagaatgcagtggctcaatctctgctcactgccgcctcgacctccagggctcaggcgatcctcctrccttagcctccagagtagctgggactacaggcgcgcgccatcgcgcccagctgattttttttttttttttttttttttttggtgaaaacagaatttcact

SEQ ID NO: 48486 - DNA, 201 bp, Homo sapiens
aggaagtcacatgttatttaacaaggtagattacttttttctttgtagtaggcaaggaaacagctatgcttcacttctaaataaaaaaaaaaaaaattttwaaaacgttttttaaaaagaaaaacgtgactaagataactgtctcattcccaggcactttttaatctcatataaatttacatttagagacttaacagtttg

SEQ ID NO: 48487 - DNA, 201 bp, Homo sapiens
cagcctcccgagtagctgggattacaggtgcacgtcaccacgcccagcgaatttttttgtattttttagtagacatggggtttcaccatgttggccaggcyggtgttgaactcctggcctcaagtgatccacccatctcggcctcacaaagtgctgggattataggtgtgagccagtgcacccggtcgagggcactattta

SEQ ID NO: 48488 - DNA, 201 bp, Homo sapiens
tcctattttttatatagttgtcaaatgttatatatttcacatggttgagaatatgttaataaaaatcattcctttaccttttcccactttgtattacaaargaaacacctctccaatgtttaaaaaaatactcaatgtaagagatgcgggttataaatacacttctgtgcatgtaaataacatttagagaacctagatgaa

SEQ ID NO: 48489 - DNA, 201 bp, Homo sapiens
agccaaggaagtcacatgttatttaacaaggtagattacttttttctttgtagtaggcaaggaaacagctatgcttcacttctaaataaaaaaaaaaaaawttttaaaaacgttttttaaaaagaaaaacgtgactaagataactgtctcattcccaggcactttttaatctcatataaatttacatttagagacttaaca

SEQ ID NO: 48490 - DNA, 201 bp, Homo sapiens
gcccaggccaaagtgcagtggcatgatctcggctcactgcaacctcagcttcccgggttcaaggattctcctgcctcagcctcccgagtagctgggattasaggtgcacgtcaccacgcccagcgaatttttttgtattttttagtagacatggggtttcaccatgttggccaggccggtgttgaactcctggcctcaagt

SEQ ID NO: 48491 - DNA, 201 bp, Homo sapiens
tggggttgaactcatgacttcaggtgatctgcctacctcggcactttgggattacaggcatgagccaccgcacccagctgaaaatttaaaagtatagatgygtgttgtattgtctgaaaaccaaaacaaaagcaagaattactggtgataataccacctagaaataaatgtcttcctattttttatatagttgtcaaatgt

SEQ ID NO: 48492 - DNA, 201 bp, Homo sapiens
gcatgctgcttcattcgattatggaaactgagcattggagacttattctcctttttaacaccacttgcctccagtaacttacactaattgtcatctatacsaagcctttgaaaatttgtagtttttgtaagtttttaggaaatatgcatgctaattagataatgcctaaattatgttgcttttcatgtgaatttagtaaag

SEQ ID NO: 48493 - DNA, 201 bp, Homo sapiens
tctgttctcaaccttcatcagattccgtaacatttgatacgttgtaaggtttctgttttcattcattatacaccttccccaccccaggccttttcattackttcaacacagtctcgtattaggatttatgttttttaaaacaattatttaggagaatagaatagtttttttctccttgtattgggttttttgtttgtttag

SEQ ID NO: 48494 - DNA, 201 bp, Homo sapiens
gggaagttttacatgtgcttgataccaagcagattgggggaagggtgtcacagatatgaaaatctgattctcttactgtctgctggagttttttttttttkttttttttttttttttacttctcagtggccccaggaactgaccgattctctttcatgagttctgagagattgctggtgataatctcgatggtgtatattt

SEQ ID NO: 48495 - DNA, 201 bp, Homo sapiens
ttttttttctcatttcaatatgtagttcacttatgttaattatttagggcttacatttttctctgttctcaaccttcatcagattccgtaacatttgataygttgtaaggtttctgttttcattcattatacaccttccccaccccaggccttttcattactttcaacacagtctcgtattaggatttatgttttttaaaa

SEQ ID NO: 48496 - DNA, 201 bp, Homo sapiens
ttttcaaacagattgggtgttttttttttctcatttcaatatgtagttcacttatgttaattatttagggcttacatttttctctgttctcaaccttcatsagattccgtaacatttgatacgttgtaaggtttctgttttcattcattatacaccttccccaccccaggccttttcattactttcaacacagtctcgtat

SEQ ID NO: 48497 - DNA, 201 bp, Homo sapiens
gtgaaatcttcaggccataataagttacttccttgcgataagttcacaggaataactagattaaaggtatgaatacattttaatttggttgaacacttacrtttatcaaaaactctttacaaaagtaacacaattatcctaataaattagaatattagaagtatataagatgaaaaaacattctcactgaacttcagtcct

SEQ ID NO: 48498 - DNA, 201 bp, Homo sapiens
gatgagaccttaagcaaatgttatatataatgagaaaagatagtcctgaagaattgagtgatatggaagtgataatggtgtactatatgggtgaaaaaatraagtactggtttagatacatgatttaagaaatagaatcctgacagttccctctgtggataagccatagaggtgtccagtgttggtttaatatagcagctg

SEQ ID NO: 48499 - DNA, 201 bp, Homo sapiens
ccctctgtggataagccatagaggtgtccagtgttggtttaatatagcagctggtttgaccgagtaccctctgctgcgtcaggtaatgttaaatgatgtcsatgcccccttgactctgatcaagacatggctacaacctgcagtttccagctttcctgggtttaagggccattgaagaatccttgtagataagagaagaat

SEQ ID NO: 48500 - DNA, 201 bp, Homo sapiens
gactgggcaaagggaaagaggccagtacgcaagagtgctgtttataaatggttaacatcgtccccagtcccgtagaagaagaatgaaatggtattctcctstttggtggttttatttgattgtttttgaattctttgtctctgacagaaggcatcttctgtatcctttatgttgtcactcactttattactctggcattat

SEQ ID NO: 48501 - DNA, 201 bp, Homo sapiens
gacacaaactgaggctgaaattgagtggcttcttaccagaaattaggtatttgaataagagcagatcgtttttacttaaaagatgtaagttttgaaaatgrccacatgcagcagttaacacactgatgactggacttacctgaagagtctctgattcagtagcccgttgtggggcccaagcatttctaataagtcctcagg

SEQ ID NO: 48502 - DNA, 201 bp, Homo sapiens
tcgtccccagtcccgtagaagaagaatgaaatggtattctcctgtttggtggttttatttgattgtttttgaattctttgtctctgacagaaggcatcttytgtatcctttatgttgtcactcactttattactctggcattattataattaggttaccttatcactccacctgccagccctatctccatccccaagacct

SEQ ID NO: 48503 - DNA, 201 bp, Homo sapiens
tgttcattatgccctttcatgcttccacatgaaagacacaaactgaggctgaaattgagtggcttcttaccagaaattaggtatttgaataagagcagatmgtttttacttaaaagatgtaagttttgaaaatgaccacatgcagcagttaacacactgatgactggacttacctgaagagtctctgattcagtagcccgt

SEQ ID NO: 48504 - DNA, 201 bp, Homo sapiens
aggtaacagaactgtgatctggtttggttttcatacctttgttgcagatatgttttcttcaaataaaaaagaaggagaggatagcaactaggaagatgaasaagcctcatcacattggatacttagtgttgtctttgtgtttacagttgctgttagattgtcattccaataaaagtaaaattatgtaatactttttaaagc

SEQ ID NO: 48505 - DNA, 201 bp, Homo sapiens
ttactggcattttccctaagcatctgcatgtgttgggtgtatgtgtaagtaccatgcattggatacatcctctgttgaaaggataaaggaatgcttgttckttccacaagttaccttggctccaactctgttccatactcagcctgttctctcaacacaatgatgtcttcagtcttaggacagaagtctggagttcattca

SEQ ID NO: 48506 - DNA, 201 bp, Homo sapiens
gtttgtgtgactatattctggctatttaacctctgctatttcacaaaaagtcctcatctgtgaaaggaggaatttggaatcgggacagttttcggaacccsttcaattgttaaagcatagcgactaagaattttatggtcatacaacactaaaaatcatacatatgtccttaggaatggggttttatttctgtaagagcac

SEQ ID NO: 48507 - DNA, 201 bp, Homo sapiens
cttgtaaagcttaagtattgtccccggtctctttaccagtcttaaggtatccctaacagaggcccaatgttcctgctaatgaaatgaataaagaaatgttrcagtccatggatttgtaattccagtaacggcttattttacatctattaaaggctacaaggaaagaagtggagggaagggctggaagactaagaaaatagg

SEQ ID NO: 48508 - DNA, 201 bp, Homo sapiens
aagaatgtatattatttaattcttgcaaagtgaaagtaaaagatcaggaaataaagacaaatcaggggaatggaacatttttagtgcgattcctcttttaytctccagcaagggaaagtggcttaaagatctctgttaaaacagtgcttctcacactttaatgtgagactcttgttatgtagattcttactcctgggtcta

SEQ ID NO: 48509 - DNA, 201 bp, Homo sapiens
ccatcattcacccatggcagccaaccagggaggtgtaaaatgcttttgtccccctgcccacatatgcacctcctttggtgtgacccatgggatgacagttrcgatgcagcttgaaaggatggctctacattgcagcttctctgcgtcatccccgttgcccttttagaatgagaaaagaggattgaaaggttcaaaagccta

SEQ ID NO: 48510 - DNA, 201 bp, Homo sapiens
  misc_feature (1)...(201): n = A,T,C or G, or insertion/deletion polymorphism (see Tables 1-2)
ttttcaccatagcatggcttgttggggcttgaagactggcattccttcttaaaggcccatcaaggttttcattcactgtgagctatgtgttaagctggtantgatctcgtttttgaccatcattcacccatggcagccaaccagggaggtgtaaaatgcttttgtccccctgcccacatatgcacctcctttggtgtgacc

SEQ ID NO: 48511 - DNA, 201 bp, Homo sapiens
aagagccagcaaattagtgaaattgtacagatgtgtgataactgacttcagtcactgagctgagctgatttacagagtgtggatttggtccagtaatatcytggaatgcagcttacagatgtaagtaagtagtgcctgattatagctacacactatagcaggtttcctaatgagctgttaaaacgaaagcatgtgtttgtt

SEQ ID NO: 48512 - DNA, 201 bp, Homo sapiens
attctggggatggagagcactttttttttttttttcttagagtcgtgctctgtcgcccaggccaaagtgcagtggcatgatctcggctcactgcaacctcmgcttcccgggttcaaggattctcctgcctcagcctcccgagtagctgggattacaggtgcacgtcaccacgcccagcgaatttttttgtattttttagta

SEQ ID NO: 48513 - DNA, 201 bp, Homo sapiens
taaaaataattcttttctttcatatatctcagtgtgagcaaatctattccaagaagcccagctaaaatatggttcattgttcccagatacaggtattcgcscacgcacagacatacacacacacacacacacacacacacaccccaattgcttgatatgatatcgattggaatttgtgaaaattactgctgagagtatttt

SEQ ID NO: 48514 - DNA, 201 bp, Homo sapiens
aaaagttcatccaccacaaaacagttggttgcaacttaggactttaaaactcttaaaagttcatttttaaatccgtggcaagaactttcagcaaggaccaracaacgcactgactggttaaagtggcctcaataaggtgtctgcccccaaggttttcagtaccagtctccatcttttcttgaaaatgagaagaaataaatc

SEQ ID NO: 48515 - DNA, 201 bp, Homo sapiens
tcatttttcaaacagattgggtgttttttttttctcatttcaatatgtagttcacttatgttaattatttagggcttacatttttctctgttctcaacctkcatcagattccgtaacatttgatacgttgtaaggtttctgttttcattcattatacaccttccccaccccaggccttttcattactttcaacacagtctc

SEQ ID NO: 48516 - DNA, 201 bp, Homo sapiens
gaaagctctattattggaaatggaaagattacaacatatgactatacaaaaagagaggtcaaagttacaaactactttctgtaccccagcagttactgaaygactttcttcctccaaagctatactgagagtgggacagccaaaactttctgattcactgagtcttcagacatctcgtgtagataaaagttgagaaaaaag

SEQ ID NO: 48517 - DNA, 201 bp, Homo sapiens
agactctgtcaagtccccaccagcaagaaggccctcaccagatgcagccctagactttggacttctcagcctttgtacctgtaagaaataaataccttttytgtataaattacccagtttcaggtattctgttataagcaacagaaaattgactgagacaatacgtatattctaattgtgttcacttttctttcatctaga

SEQ ID NO: 48518 - DNA, 201 bp, Homo sapiens
tctaaaacttcatcaggtcatgaggttttattgacatcagtgtatttggcttcagctgtgataatcatgtggcgcagtctcttttcctccccgcaatgccytgcctcccttggaagactccctccaccccaccccagccccattcagcttcgttcagaaaaaccttcatttttatctcccattaaagtttgtctgatgaaa

SEQ ID NO: 48519 - DNA, 201 bp, Homo sapiens
ctgccctcatgaatggattaatccattcatggattaatggattaatgggttatcaggggagtagggctggtggcttttaagaagaggaagggacctgagcyagcacactcggccgcctcaccatgtgattccctgtgctgcctccagactctgtcaagtccccaccagcaagaaggccctcaccagatgcagccctagact

SEQ ID NO: 48520 - DNA, 201 bp, Homo sapiens
ggttttggtgctcaacttttgactttacccaccttcctgacaaagtgttgaggaccactaggtaagcatgctatcttcaacgttaaaaaaaaaaatcatgrttgaaggcagctgcacttcatatatcaaggagcattgaatataactaactctaaaacttcatcaggtcatgaggttttattgacatcagtgtatttggct

SEQ ID NO: 48521 - DNA, 201 bp, Homo sapiens
cactcatcggggtatatttgagtatgtagctcactgtagacagagctcctggggagggaggaatggctctggtgctcttctacccacctgtagaggttcakctggggaccagctccactgtggggcattgggaggctgttagtgcagaggtatcttctcagtatctgcctgacacactactgtatccagctgcctgaccca

SEQ ID NO: 48522 - DNA, 201 bp, Homo sapiens
aggtgcacaccgccatgccccactaatttttgtatttttagtagagatggggtttcactatgttagccaggctggtctggaactcctgacctcgtgatccrcctgccttgacctcccaaagtgctgggattacaggcatgagccaccgcacccagcaatacattttaagttttcataaacttttgaatataaagaatttat

SEQ ID NO: 48523 - DNA, 201 bp, Homo sapiens
gaaatgagaagaaatgcacaaaggagagttgcatttcctcctgcttctgtcaaaggaaaaaaagatgttatgtgccttctctttccacctctaaataaagsaacagggccaccactaactagtttgtgtgactatattctggctatttaacctctgctatttcacaaaaagtcctcatctgtgaaaggaggaatttggaat

SEQ ID NO: 48524 - DNA, 201 bp, Homo sapiens
ttttctttgtgcccatatcaggtagctatgattatcttcattttacagagaagaaaacaaagctcaagagttaatttgactaaattcacagatgagtgaartatgaggtagagagtgatcctgtgtgagaatagtttacatttatcttgatgtggttataaccactaccttatctataatgcatgttaaaaatcaacttct

SEQ ID NO: 48525 - DNA, 201 bp, Homo sapiens
gtttacatacatttttttttcttttgagatggagtcttgctttgttgcccaggctggagtgcaatggtgcgatctcggctcaccacaacttacacctcccrggttcaagcgattctcctgcctcagcctcctgagtagctgggattacaggtgcacaccgccatgccccactaatttttgtatttttagtagagatggggt

SEQ ID NO: 48526 - DNA, 201 bp, Homo sapiens
caacagggagtcctttccccattgcttgtttttgtcaggtttgtcaaagatcagatagttgtaggtatgcggccttatttctgggttctctcgtctgttcmcttggtctgtgtgtctggttttgtaccagtgccatgctgttttggttattgtagcccagtagtgtagtttgaagttgggtagtgtaatgcctccagcttt

SEQ ID NO: 48527 - DNA, 201 bp, Homo sapiens
ctaacagaggcccaatgttcctgctaatgaaatgaataaagaaatgttgcagtccatggatttgtaattccagtaacggcttattttacatctattaaagrctacaaggaaagaagtggagggaagggctggaagactaagaaaataggaaatgagaagaaatgcacaaaggagagttgcatttcctcctgcttctgtcaa

SEQ ID NO: 48528 - DNA, 201 bp, Homo sapiens
tgcttcctccccaacctccaccctccattaggctgcagtgtctgttgttgtcctctatgtgcccatgtgttctcatcatttagctcccatttataagtgasaacgtgtagtatttggttttctgttcctgcgttagtttgctgtgggtgatggcttccagctatccatgcaaaggacatgatcttattcttttttatggct

SEQ ID NO: 48529 - DNA, 201 bp, Homo sapiens
catcacggcagaagttgggtctgattttgcttgattttgccttgatgtttggctcatagttgcaattcactaaatatttgttgaatgaaaaaaatgaaatyagcatttcattgttttattaacacattagagaggcacccatgaaaatgtgtgcttctcatctttgtggagtaagtactgctattcattcttacaagcagg

SEQ ID NO: 48530 - DNA, 201 bp, Homo sapiens
ttcgtcttagaagagaagtttccatctgactccatgttttctattgtagaccctagttcagtgccttttaaacagcagatatggaataatcctctaatggrataaatggggagaagaagggatagtttgtggttacctgggaaagcagtgtggttaagtcagcatgggtttctcaagaacaagcctttcttgaattaacct

SEQ ID NO: 48531 - DNA, 201 bp, Homo sapiens
tgggattttgccatgttggccagcctggtcttgaactcctggcctcaagtgatccacccacctcggcctcccaaagtgctgggattataggcgtgagccaycgtgcccggccaacagtgtcttgttattttaccagtgatatgcttacagttcctaattttaggcttcctccttattttggttttattgttcagtttgggg

SEQ ID NO: 48532 - DNA, 201 bp, Homo sapiens
ttgactggatgatgcgtaggaataacaagaggtctgaggcatagtagtagacccatggagctgatagtttcagggcagggtagacatctaataaagtcttygtttccttttgtaagtttctctaagtttgtttaggatacctattttgacagccatacagatcttcagaaaatagggattatcaccagacaccacaaggaa

SEQ ID NO: 48533 - DNA, 201 bp, Homo sapiens
ggtgtggtggtggcatgcacctgtaatcctgaccagccagctgagatcgtgccactgcacttcagcttgggcgacagagcaagactccatctcaaaaaatrtgtatattatatatatatgacttcatagacacacattggtctatacaacaaaaacaaagcattaggaaattatctcatgatttagccacaaaattaaaag

SEQ ID NO: 48534 - DNA, 201 bp, Homo sapiens
aggcgtgagctgccacgcctggccttgatttgtttttgcatgtgagaaaatgtatgtcctagtgtagtgtggtgtgtcattagaagcatgatttgttcttwccaatgcagtgattacattggttcttctacattcagtagaatgctaataatgtggtaatgctagtcgccagtcttcttaatctctataacagaggaagca

SEQ ID NO: 48535 - DNA, 201 bp, Homo sapiens
gactactttattaaggtataattcacaaaccatgcagtccaccctttaaagtatacgatgcaatggtttttagtaaattaacataatcgtgtaaccattgscataaacaacattagaacattttcatcaccccaaaaaagaaaacccatacccattggcaatcaaaagccgatttcctccccaaccaccacacacccccca

SEQ ID NO: 48536 - DNA, 201 bp, Homo sapiens
ttggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagc

SEQ ID NO: 48537 - DNA, 201 bp, Homo sapiens
tgttcattttttctctggcctttcatcatctgtgacagtactttgtttagaaaatggagggtagggtggcacttgtatagcccattttgtatggttcaacmttcatttcattgtgactaatgatgactgatagctgatgtcataagtagtgtttcttgcagcaaagtttcataaattttagcatgcatcacaatcacttgg

SEQ ID NO: 48538 - DNA, 201 bp, Homo sapiens
actgtttttaaaccaagccactttagactttgccagtccttctgtagtcccctattcaaaactttgtttatacctttcaggaatattttatctagtacttyattgatttcatccagttatgtgccccttctctccattttttgacagtttctactttattccactcctccaacaactccttaatttctgctgtatcagcag

SEQ ID NO: 48539 - DNA, 201 bp, Homo sapiens
tagctggcggtacaggtgcacaccactttagtagagacaggtttcactttattggtcagactggtcttgaactcctggcctcaggtgatccacctgcatcrgcctcccaaagtgctgggattacaggtgtgagccaccgtgcctggctttattccttcttaatgaggcacaaactcagtttctgcgtggtacatatagcct

SEQ ID NO: 48540 - DNA, 201 bp, Homo sapiens
gttgcccaggctggagtgcagtggcacgatctcagctcactgcaacctctgcttcccgggttcaggtgattctcctgtctcagcctcccgagtagctggcrgtacaggtgcacaccactttagtagagacaggtttcactttattggtcagactggtcttgaactcctggcctcaggtgatccacctgcatcagcctccca

SEQ ID NO: 48541 - DNA, 201 bp, Homo sapiens
tttatagtctcatgctgctagttttggggtaatttgcttttttttttttttttttggagatggagtctagctctgtctggagtgcagtggggtgatctcgrctcactgcaacctctacctcccaggctcaagcaattctcctgcctcagcctcccatgtagctgggattacagctacacaccaccacgcctggctaatttt

SEQ ID NO: 48542 - DNA, 201 bp, Homo sapiens
tggggtagagcctacatgtgtattttggaaaggcctttctgatcgttttgccaagtgctcctggctaattaataaccaccaagagccactaaactcaacartctccaaggtcccttcacatgcagttgccacatttagcaaacaaaaatgcagagcatccagccaaatttgaatttcagataaacaatgaatactttttta

SEQ ID NO: 48543 - DNA, 201 bp, Homo sapiens
cccattggttatatgagaaaatgtattctcctggctttctactcagactttctgacacctcagggtagaggagagggctggacaggcactcttgacaaccygctagctctttcagagatgtaaatgcaaaggcctttcagagctagacagctgacatacagatgtgaagtaactgggataagctatcagggctatttaaaa

SEQ ID NO: 48544 - DNA, 201 bp, Homo sapiens
aatactgagccattgctcctaggggaacaatacagagttagattcctgtgagcctctggttataacgattttgtcagctgtcaaccgatcaatacatagcyttgttttgcatgtgtttctgtttaaagataccttgtttaatatacattgttgattcattaacattgacctcatggcgaagagcactgtatctcatgccta

SEQ ID NO: 48545 - DNA, 201 bp, Homo sapiens
gcaaacacccattggttatatgagaaaatgtattctcctggctttctactcagactttctgacacctcagggtagaggagagggctggacaggcactcttsacaacctgctagctctttcagagatgtaaatgcaaaggcctttcagagctagacagctgacatacagatgtgaagtaactgggataagctatcagggcta

SEQ ID NO: 48546 - DNA, 201 bp, Homo sapiens
aactgctcactgcaggaaataggggaaatagaggataatttggaagaacaccccactgttattatttgtggcagttatgttctataaagtcgctgtggacrtaattagtgaatactgagccattgctcctaggggaacaatacagagttagattcctgtgagcctctggttataacgattttgtcagctgtcaaccgatca

SEQ ID NO: 48547 - DNA, 201 bp, Homo sapiens
catgcaaatggggttccatttcccacaccagggcagcttctgtcatctcagaatgcccacctggcatcttcctgacccttggctcacccacaaggaagttsatggcaatattgttttcagaagccaatattctcctgtctctacttgcaagaaaataactgagcccccccagtaagtataattggtgcgaacagtgattta

SEQ ID NO: 48548 - DNA, 201 bp, Homo sapiens
ttgaacaaaccagctttgagatgataaaaatttgaatatgaattgagttcttgaagataagaaattgttaattttgttaggtttgttaatggcatggtagktactctaaaaacaaatttctgggcgagtgtagtggctcatgcctgcaatcctagtactttgagaggccaaggcaggaggatcacatgagcctgagaggtt

SEQ ID NO: 48549 - DNA, 201 bp, Homo sapiens
gtatggggactttggactcctgtttgaacaaaccagctttgagatgataaaaatttgaatatgaattgagttcttgaagataagaaattgttaattttgtyaggtttgttaatggcatggtagttactctaaaaacaaatttctgggcgagtgtagtggctcatgcctgcaatcctagtactttgagaggccaaggcagga

SEQ ID NO: 48550 - DNA, 201 bp, Homo sapiens
gatagtgccagctgagtggaatgtgcaggaagggaccgaggaggggcactatgtactggagaaaagagatggggtctccaggacaggggtaaggacactaractgagggcacaaaggaaggaaaccacaaggaagtagagtagggaagtggggagcatgctgaggagagaggtcaagagatggtgaccgctctctgcatgc

SEQ ID NO: 48551 - DNA, 201 bp, Homo sapiens
ccctgcttcatgatgttcctgaatagttttagttttctttgtttatttttccactttcttgggccagacctccaatttaattcttttagttgaatgagctkctttctcgcttgttacagactcacttagggctcattcctccctgccttagtcccagtatggtctcagtaatgacatgcagtatggggactttggactcct

SEQ ID NO: 48552 - DNA, 201 bp, Homo sapiens
aggaattagatacaatgactatgcggttttgctttttagtaactgtttctcattacttcattgatccaaagtgagatttttaaagctaaagtccttgttcsattaagataattctgtcatttgtccagttactctccttactcaaattgctagcccctttggtactttctctctagctcttgccctgcttcatgatgttcc

SEQ ID NO: 48553 - DNA, 201 bp, Homo sapiens
tttaaagaggaggagaaattttagagctatttctgataataaacctcaaaaagtgagaagtattagaatttatcttggttaattttctttttttaattaaygagcatgcattgcttatataaaacttttctctgtatgtgtctgtatctgatgcagttagaagttcaatgtgagtttagtgattcccagggaagacttagg

SEQ ID NO: 48554 - DNA, 201 bp, Homo sapiens
agccatgattgtgttactgcactccagcctgggtgacagacagcgagaccctgtctcaaaaagaatgcaattgtaattttgtcacctttatttaaaaaaaycatttatcaggtggttgcaatgaaaagcaatttagttgtttacaacctctaccttctagggacttaagtgtgttcagaagtatttaaaatgaaataatta

SEQ ID NO: 48555 - DNA, 201 bp, Homo sapiens
ttccctttttattattagaatagtaagaattctatatgagtagaataagaaaaagttaatgtggcattcacaatttattaatgtcccttcatccatttacycacattcctttttattcttttttttttttttttttttttgagacggagtcttactctgttgcccaggctggagtgcagtggcacgatctcagctcactgc

SEQ ID NO: 48556 - DNA, 201 bp, Homo sapiens
aggccagaagcaagatggagttgaaccatgctagatttctctcaatgtcatcatttttgcaaaaggactttcagatttagtggcccactgatatcattagrggcccaggttcttatcgtcacttcactctgccatccactatgcactggtacatcctgagacttgctctgcctcttggcaaaatggctacagaagtgccag

SEQ ID NO: 48557 - DNA, 201 bp, Homo sapiens
atagtagtgatgttatctataggagcaattggggaagtcacaaaccttgcaacctctggccacctgacttctgagcagtaagagattatagaaagtatgcytacatgttagcagaattcaggcccctcccattattctagtcttgtggcctttattagtcttacaaaggcagtttcagcacctgaacaaggaagggaatga

SEQ ID NO: 48558 - DNA, 201 bp, Homo sapiens
ccgtagcattgtgtctagcctttaacagtcacttaataaaggcaatgaaaaggaaataacatttgaccttcaatttaagtttgactaggtatggtcaaacrttagaaagtggcagtgaacttcttttgaagtcagaattcatattttcctttaacatcagatattggcagccagcttttccagattttcttggccaaaaat

SEQ ID NO: 48559 - DNA, 201 bp, Homo sapiens
atcccacgcactgaggcttatctgtacttccagcccagacctccctcctaattccccactatacctgtgcactgaaacaccctcttaggatctccttcttscacattcctcctcctctaggcaaggcaagtcgttttcctcatctcagccagagcagtagttactgaaaactaacccaatatggtggcttctgagctcagg

SEQ ID NO: 48560 - DNA, 201 bp, Homo sapiens
atggaagttctgcagaaaataaaaactgaacttccatatgatccagcaatcctacttctgggtatacatccaaaggaattgaaatcaaagagatacctgtrcttctgtgtccctcgcagcatgattcacaatagtcaagttatggagacagtggaagtgttcatcagtagatgaatgggtaaagaaaatgtggtatatgtg

SEQ ID NO: 48561 - DNA, 201 bp, Homo sapiens
gtcactctctctcttcccccagccacagtggcagctgcctaacttggtttcttgctggtgcacacatgtgacagaaatacaatgttaataaatatttctaygtgtaatggagaaacaagccataaaagtagctgtttgccatctgctcagatacattattaggaaaggcaatgacattttatgattcagtaacttaactat

SEQ ID NO: 48562 - DNA, 201 bp, Homo sapiens
agaattattgattattaaaactacattcttggccaagtgcaatgactcacgcatgtaatcccagtactctaggaggccgaggcgagcggatcacttgaggycaggagttccagaccagcctggccaacagggtcaaatcccatccctactaaaaatacaaaaattagctgggcatggtggcacatatgcctgtatgtgcca

SEQ ID NO: 48563 - DNA, 201 bp, Homo sapiens
tttcctttctctgtagtatgtaaaataatgtatgtttgtgatcagtgagatctcagatctgataaaatgcagtgttttgtcatgagagttgctcccagccrctgatggggttgccttgttcagcactttttagcaccaggggagtaagccatgttcttgctccccctccctcaggctgaggctttgcttgatcacctgcta

SEQ ID NO: 48564 - DNA, 201 bp, Homo sapiens
gcactttgggaggctgaggctggcggatcacaaggtcaggagtttgagaccagcctggccaacatagtgaaaccccatctttactaaaaatacaaaaaatkagccaggcgtggtggcagcacctgtaatcccagctaatcgggaggctgaggcaggagaatggcttgaacctgggaggcggaggttgcagtgagctgagat

SEQ ID NO: 48565 - DNA, 201 bp, Homo sapiens
tcaataagaattattgattattaaaactacattcttggccaagtgcaatgactcacgcatgtaatcccagtactctaggaggccgaggcgagcggatcacytgaggccaggagttccagaccagcctggccaacagggtcaaatcccatccctactaaaaatacaaaaattagctgggcatggtggcacatatgcctgtat

SEQ ID NO: 48566 - DNA, 201 bp, Homo sapiens
gtgaaaattacaacaaaaaaaaaagaaaaacacagaatctgactaaaggagcattcagaatatttgtatctagaataacaagtataattttattggcacartgcttttacagtatataaaacacttaaaatacagttgcttatttcatttcctcagtaatcctagagagtatttcctgcatcttattgatgaggaattgaa

SEQ ID NO: 48567 - DNA, 201 bp, Homo sapiens
gaggattgcatagaagcatcctgacaagggtgccaagaatacgcagtgggggaaaggacagtctcttcgaagaatactgttgggaaaactggatatccacmtgccaaaaaataaaattggacccttaacaccatatacaaaaatcaacttgaaatggattaagacttaactgtaagaggccgggtgcagtggctcatgcct

SEQ ID NO: 48568 - DNA, 201 bp, Homo sapiens
ccaaaaggatttaatgcagttagtatgtagcaggttaatttcagtagatgactctaagttatgattttcatccagaaagaattattttcgtcagctttccmccagtggaacatacttcctcctaagctccctgcctctgaaagcataggcaggggagccgtgtattagagacgttgtggggaagatctccacatttggaaa

SEQ ID NO: 48569 - DNA, 201 bp, Homo sapiens
aaagtaagttaccaaaaggatttaatgcagttagtatgtagcaggttaatttcagtagatgactctaagttatgattttcatccagaaagaattattttcrtcagctttccaccagtggaacatacttcctcctaagctccctgcctctgaaagcataggcaggggagccgtgtattagagacgttgtggggaagatctcc

SEQ ID NO: 48570 - DNA, 201 bp, Homo sapiens
aagatcttgtaagtagaccagaataggccagtaatttggctccatgcttcctagcagccaaggcaaagaagtaattgtgaccagatacatagttcacagcrtctttaagattcagtaagctagcaactcaagaaaagcacaagtagtcaccatatagggacaagtggaccatgctgtgaacagcacactagatagcaagta

SEQ ID NO: 48571 - DNA, 201 bp, Homo sapiens
tataatttatagcagtggttctcaaactttagcgtgcatttgggtcctctggagcattatgttaaaacacagatagctgggctccaaccccagaccttctsattcaggagttctgggactggcgtacaaatgtacatttttgacaagttaccagctgtatgagggttctccaaagagacagcataggtatattaggaagga

SEQ ID NO: 48572 - DNA, 201 bp, Homo sapiens
ctcattacttcattgatccaaagtgagatttttaaagctaaagtccttgttccattaagataattctgtcatttgtccagttactctccttactcaaattsctagcccctttggtactttctctctagctcttgccctgcttcatgatgttcctgaatagttttagttttctttgtttatttttccactttcttgggccag

SEQ ID NO: 48573 - DNA, 201 bp, Homo sapiens
tggtctttgatcaagaaaggtggatcaaatttgtgtctatcccattgttgggagggaagctaaccaactggatgtcagacatcaggatagaaaaaaaaaasgctgcaaaaagttgaaggcaatcaacatgaacaaatacacaattaagctctactgaatgcagcttcctagagtcgggggaaagttgcatgtttatagaat

SEQ ID NO: 48574 - DNA, 201 bp, Homo sapiens
gggtgttttttttttctcatttcaatatgtagttcacttatgttaattatttagggcttacatttttctctgttctcaaccttcatcagattccgtaacayttgatacgttgtaaggtttctgttttcattcattatacaccttccccaccccaggccttttcattactttcaacacagtctcgtattaggatttatgttt

SEQ ID NO: 48575 - DNA, 201 bp, Homo sapiens
attaagtgaaaagatgttgtctgcatgcaacttactgaaaaatactataaatgaccccaaagctttgaccagcaaagatatggtgagtctgacctgcaaasaccatccccagtgtgtacaaagtgcatgagtgggttcattgtcaaggccagctgtaggctgcccgagctgttgcttgcatgcttttctcctgaactgttt

SEQ ID NO: 48576 - DNA, 201 bp, Homo sapiens
tctagaatttcagtacaagctgtacataaaatatttatacagcacagtgtgctttgcccctcacaaaagcgtgggttcagatgtacactgttactatagaygtcactaacatataagccggtgaagaacctttaatgtatttgtaatgttagcaaagtatctgtcatcagattaaacttgtagtgactgataatgtagcct

SEQ ID NO: 48577 - DNA, 201 bp, Homo sapiens; identical to SEQ ID NO: 26259

SEQ ID NO: 48578 - DNA, 201 bp, Homo sapiens
ctgggaaataagctcattctattagcttgtttctcagctagcttatgtagaaatttgccacagttgttactgctgggcacctgccctggatctgatcatcmattatatcatctcttccatctgatggactgcacctcaccccttgctttttcagagctggcgaagctgggccaaggaaagcgatagtgccagctgagtgga

SEQ ID NO: 48579 - DNA, 201 bp, Homo sapiens
ctcccaaagttctgggattataggtgtgagccagtgtgccagccaagaattaatttcaacattagactcagccagagttaatgaagaagctttccccacawgatggctcctcacaagaaatactatctatttataatattcattggctttacttgtctttaccaagccttcctgagtgtcatcagtgggtgagtgagtgta

SEQ ID NO: 48580 - DNA, 201 bp, Homo sapiens
tatgattttcatccagaaagaattattttcgtcagctttccaccagtggaacatacttcctcctaagctccctgcctctgaaagcataggcaggggagccrtgtattagagacgttgtggggaagatctccacatttggaaagctgaagatctgcagattaggggtgacactcaaattccttaaggggttgggcagataaa

SEQ ID NO: 48581 - DNA, 201 bp, Homo sapiens
acactcaaattccttaaggggttgggcagataaattgtgtaaaatggtaaggcattagaaagtggaccagactgcagaggactggagaggcacagcccacytaaagacattcaaatttggtacagatgcttcttggcttaccatggggctactgtgtcccaataaacccacctaagtgaaaaaatgcatttagtacaccta

SEQ ID NO: 48582 - DNA, 201 bp, Homo sapiens
ttttatctaataagagccaaacacattaacctctgtggtaggagaaagtggagttgaacagaagtattgaatgtggtctccatcctcagaaaactcaaaamtactttaaaataagatatgtccatacaaaggcagccaacaacggcgggcaaaaagctcatgacggctcattaggaagcatttctaactttgatctagatg

SEQ ID NO: 48583 - DNA, 201 bp, Homo sapiens
cagaagtattgaatgtggtctccatcctcagaaaactcaaaactactttaaaataagatatgtccatacaaaggcagccaacaacggcgggcaaaaagctyatgacggctcattaggaagcatttctaactttgatctagatgggttcagaaagagccacagaataggcaaggcttgagtggggcttaaaagaacaaatag

SEQ ID NO: 48584 - DNA, 201 bp, Homo sapiens
aggttttaattgtacagtcaacactgtcattcacttgtgattttcattttttccaagcttagaaaacttgaaggatgatgacttttttattggagaggttraaaaaaaaaaaagtaggtaaaagtgatggatgcttaggctgagggtggtgactgaatatgtggtacttgaaattgagtttgagtgtccaggcctggtttc

SEQ ID NO: 48585 - DNA, 201 bp, Homo sapiens
ttttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcc

SEQ ID NO: 48586 - DNA, 201 bp, Homo sapiens
gaccatagaatatggcagaagtgatggtatgtcacttctgagattcggttataaaagacattgcagccaccatcttggtcattctttttgtctttctctcyatccccacttggtctggagaaaaccagctgccatgtcatgggacagttcacgtgacaaaccttttgccagcaaccatgtgagttgctgagcctccttaga

SEQ ID NO: 48587 - DNA, 201 bp, Homo sapiens
  misc_feature (1)...(201): n = A,T,C or G, or insertion/deletion polymorphism (see Tables 1-2)
ttacccatagttacctgatttaaatgtgaatctcatccaaaaacatcctccaagtcaacacataaaattaaccatcataccctgctacgagcaccttgggnaaaccagttggaagcttcatggccttttatgacatattatcagaagttaataacttcccttttgccaaactattggttgtagcacaaaacttgctcaggc

SEQ ID NO: 48588 - DNA, 201 bp, Homo sapiens
tcctggtttttattagatatcttattatttttgccttattatttttagttgtcttcttttggttacctttctgatttaaaataaagcagtccattctttaycaggccgtagagatatggaaaactcaggtttgttgaagggtatggtgttggggagggacatggcagaaaagcagcttcaaatggttgaggcttgacaatg

SEQ ID NO: 48589 - DNA, 201 bp, Homo sapiens
ttgtggtatgagagagtgcccatctccttggggacctagccccttgatggttccagcactccatcgaaaaccagctccactgtggggtgttttgtgtgacrtggtggtgtcatatgtcttctctgcaagaaaaggcattgttaccaaggcaaacagaaatactcgatacagttatgtataaaccagaggaagcctttgcca

SEQ ID NO: 48590 - DNA, 201 bp, Homo sapiens
cctgcccacacttctttctctccagatagagaaatagctcacatttttggtgcctactctgtactgggcactgtactgtgagttttcatgtgtgacctcasaggtactatgatcatctccaagtgacgttcagagaggtggtctgccccaggtcacagggctaaaattagtaacatgtaaggaaaatggctttactctcag

SEQ ID NO: 48591 - DNA, 201 bp, Homo sapiens
gagatgtggttgttatcttaggaagatgactataatatgaagttaaaagttacaaaggaacatttgggaagaatgtataggtacatacatgcttataaaascacaagaaagaactgggaagcaatacaccaaagcgttgatagtagtagaattacggctgattttttactttctctgtcatgcatttctttattgttgaat

SEQ ID NO: 48592 - DNA, 201 bp, Homo sapiens
aggaggccgaggcgagcggatcacttgaggccaggagttccagaccagcctggccaacagggtcaaatcccatccctactaaaaatacaaaaattagctgsgcatggtggcacatatgcctgtatgtgccagctactcgggaggctgaggtggaagaattgcttgaacttgagaggtggacgttgcagtgagctgagatcg

SEQ ID NO: 48593 - DNA, 201 bp, Homo sapiens
ttgtgattttcattttttccaagcttagaaaacttgaaggatgatgacttttttattggagaggttaaaaaaaaaaaaagtaggtaaaagtgatggatgcytaggctgagggtggtgactgaatatgtggtacttgaaattgagtttgagtgtccaggcctggtttcattatatcttgggacacttaaaaaagtcttgcag

SEQ ID NO: 48594 - DNA, 201 bp, Homo sapiens
tgtgccagagaagctttctgcgcacagctgggtcctgtgaggcaagacctgtgtcctgctgactcatacacagcatcccatatggccttaactttatttarcaacgtcagctcaaggaagccttgtgttccctttgggcccaggatttagaagagcataatcatagaatgtctgtcaggcctggaagtgtcattagggctg

SEQ ID NO: 48595 - DNA, 201 bp, Homo sapiens
acggagtttgaggatcttgccgtctggcttcctccttgcctcagaccctgccctttaggggttactgccctaagaggctgaaagtttagtaatgccccagrgcctcgttgcaggagctagtcacttttggcactttcttgctgtcagaccgcaggctctgggagccagtcttcttgggacatggcttcatcctgtgtctct

SEQ ID NO: 48596 - DNA, 201 bp, Homo sapiens
gctgaaagtttagtaatgccccagggcctcgttgcaggagctagtcacttttggcactttcttgctgtcagaccgcaggctctgggagccagtcttcttgkgacatggcttcatcctgtgtctctggcttgagcccaacctttcaggcctgggttaggggtgaagccttttatctggcaggtcccacagtctggcgccttt

SEQ ID NO: 48597 - DNA, 201 bp, Homo sapiens
tgaatatttgcctgtctagcatgggtaggtgaacgtcagcagaactcttgaagaatcactaaagggatgtgcttgtcctagcaggagagcctgtgacaatraaaaagcagagaatgttctgagtctcctatattaaaaagggaaaagcttaagtgaggtttatttccactaaaggatagcaacataaggcagcttgacctt

SEQ ID NO: 48598 - DNA, 201 bp, Homo sapiens
tgaacgtcagcagaactcttgaagaatcactaaagggatgtgcttgtcctagcaggagagcctgtgacaataaaaaagcagagaatgttctgagtctcctrtattaaaaagggaaaagcttaagtgaggtttatttccactaaaggatagcaacataaggcagcttgacctttagtgtgactggagcaccgtaaatgctac

SEQ ID NO: 48599 - DNA, 201 bp, Homo sapiens
ggatggtcttgatctcctgacctcatgatccacccgcctccgcctctcaaagtgttgggattacagacgtgagccaccatgccctgcctcaagatgatcaytttatgaattataagtcacaatacgagaggatgatttgggtgttgatggtgtattagtgctccacaatcagctttattattctttggacctgtggatgtt

SEQ ID NO: 48600 - DNA, 201 bp, Homo sapiens
tcccccaggccgcggcgccgccgcccccgcagctgggctattacaaccccttctacttcctgagccccggggccgcggggcctgacccgcggacagctgcyggcatcagcacccctgctccagtcgcgggcctgggaccccgggctcctcacgtgcaggcgtcggtccgggccactccagtgacgagggtaggatccgcag

SEQ ID NO: 48601 - DNA, 201 bp, Homo sapiens
cctcatgatccacccgcctccgcctctcaaagtgttgggattacagacgtgagccaccatgccctgcctcaagatgatcattttatgaattataagtcacwatacgagaggatgatttgggtgttgatggtgtattagtgctccacaatcagctttattattctttggacctgtggatgttaggtcaggtactagtctgcc

SEQ ID NO: 48602 - DNA, 201 bp, Homo sapiens
ttacttaagggatcaatctaggtggtgttcttggtcttaaatttaacagcaaacacagcacatatctattatcactatattaattttcaaaggtttttctmtgacgtttaaaactgtgacaacagatattcacatttgattatagaaacttaatgtctattaataattttagtacaaaatttcataaaccgtgtttttcaa

SEQ ID NO: 48603 - DNA, 201 bp, Homo sapiens
cacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaag

SEQ ID NO: 48604 - DNA, 201 bp, Homo sapiens
agccttgatctcctgtgcccaagtgacactcccacctcagcctcacaaggagctgggaccacaggcatgctccaccatgcctagctaattaaaaaaaaaamttgttttttgtagagatggggtctccctatgttgcccaggctggtctcaaactcctgggctcaaatgatcctcctgccttagcttcccaaagtgctgaga

SEQ ID NO: 48605 - DNA, 201 bp, Homo sapiens
ttttttcttcatagtagataggcttatatttattaagttaaaacaaagtttgaatatttatttcagttgtgttacatgattgtagacctcttttacagtayacattttcaagatgatttttttttttttttttttgtgagacggagtctcactctgttgcccaggctggagtgcagtggcacagtctcggctcactgcagg

SEQ ID NO: 48606 - DNA, 201 bp, Homo sapiens
attcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtcttt

SEQ ID NO: 48607 - DNA, 201 bp, Homo sapiens
ttcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtcttta

SEQ ID NO: 48608 - DNA, 201 bp, Homo sapiens
gatctgcccaccttggcctcccaaagtgctgggattacaggcatgagccactgcacctagccaacaatctaattttagattatcagcccaagacgaaaaastaatcgaaatttataattattcatgtcttttccacatgtctacttttctgttttttttcccaaattttaactaatcattaagtaaaaacttttggaagag

SEQ ID NO: 48609 - DNA, 201 bp, Homo sapiens
tcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaa

SEQ ID NO: 48610 - DNA, 201 bp, Homo sapiens
tgcacctagccaacaatctaattttagattatcagcccaagacgaaaaagtaatcgaaatttataattattcatgtcttttccacatgtctacttttctgttttttttcccaaattttaactaatcattaagtaaaaacttttggaagagagacattttacaatttctttgtaatatttttcagtcttagaaactcaaata

SEQ ID NO: 48611 - DNA, 201 bp, Homo sapiens
attttaagaaataactagaaaggaaaaaaaatagcttactgaattctataagatgtgtgggaatctcacctatcaaaaataggtaaaaagagcctccaaamctgctttgattttattcacctattcttttaggccaggaactaatttacctctcactatcctgttccctcttgctatcttgtggagtctctaaagacaaag

SEQ ID NO: 48612 - DNA, 201 bp, Homo sapiens
agctgggtaagccttacctttagactactctgtgactacagaaataaagccagcacttttggaactaataagccttcacttgtcagtatcataaagagtaytgcccaactgaactttgctcccactggtttaatagttacttatttctgcctaagcactcaccttccgattttacccaagtatatatataggatagaaaaa

SEQ ID NO: 48613 - DNA, 201 bp, Homo sapiens
ttaacaataagggaacaaaatttagtattcaagctgagtgagaatactgtttcaatgagcatgtccctaagataaaccagaattggcagttaatttaggcrtctagaaaatctcagttcccaccagtaaaattatcctgagtagctaatgcaccttgagaaaaatctggcatactgaataaataacattaacttgggagcc

SEQ ID NO: 48614 - DNA, 201 bp, Homo sapiens
tcagtcttagaaactcaaataaaatttcacttatagattgtggtccaaaaatatacttgtaaattgcaatgtagttttctgcagaagcagcttactagaargtatagtagtcatagagaaatattacaggagacagacatcttgtggtattggacatgttagagacctacagaaatgcataaagttaaatggttaactttt

SEQ ID NO: 48615 - DNA, 201 bp, Homo sapiens
tagatggttgggaatctaaagattagtttagaatttcaattaaaatgtatgacttgcactaatgaaaaaaaagtcagtgctactgttctggtaactaattmtttataaccccaaactattattttgtgtagggatatctctaagtttgctatgcattatataatagaagaaatagatgaagacacatcaatggaagacttg

SEQ ID NO: 48616 - DNA, 201 bp, Homo sapiens
ggctaacttctcttcatccttcagagcctcatctaactgtcttttctgggaaaccttcacaaggttaagtgtatctggtgtatgtttccatagtatcctargttccccatcacagcactcatcccactttattattgctatttatttattgttctgttttctttgctaggttagaccctccacgaaagcagggaccgtgta

SEQ ID NO: 48617 - DNA, 201 bp, Homo sapiens
accatgcctagctaattaaaaaaaaaaattgttttttgtagagatggggtctccctatgttgcccaggctggtctcaaactcctgggctcaaatgatcctsctgccttagcttcccaaagtgctgagattacaagcatgagccaccacacctggcccattttttatcatcattgcttctccctactccgattactgtcgtc

SEQ ID NO: 48618 - DNA, 201 bp, Homo sapiens
ggggcttccgcttccggcgggggattgttgacgcctgcggttgctgcggtggtgacggggctgttggggaggggccattgggggagggaaacggagcagtracaggtatcccagagggtgctgctgaggcgacgatggccgaggggcccgaggaagcccgaggccaccctcccgggcaggacgatggcggaggggaccacg

SEQ ID NO: 48619 - DNA, 201 bp, Homo sapiens
cttccgcttccggcgggggattgttgacgcctgcggttgctgcggtggtgacggggctgttggggaggggccattgggggagggaaacggagcagtgacargtatcccagagggtgctgctgaggcgacgatggccgaggggcccgaggaagcccgaggccaccctcccgggcaggacgatggcggaggggaccacgagcc

SEQ ID NO: 48620 - DNA, 201 bp, Homo sapiens
ttttatgaattataagtcacaatacgagaggatgatttgggtgttgatggtgtattagtgctccacaatcagctttattattctttggacctgtggatgtkaggtcaggtactagtctgccttgagtctccatttggccatgcctgtcattattccatcttgaataggcagcagagttttgacagctatgcattcgtgcat

SEQ ID NO: 48621 - DNA, 201 bp, Homo sapiens
aagtgcacgagtggctgtggcagtcctactgcggctacctcacctggcacagcggcctggccgccttcccagcctactgcagcccccagccctccccgcaragcttcccttcgggcggcgctgcagtcccccaggccgcggcgccgccgcccccgcagctgggctattacaaccccttctacttcctgagccccggggccg

SEQ ID NO: 48622 - DNA, 201 bp, Homo sapiens
ggggcccgttgggtgggggggcgggacagcattaggaaaaatagctaacgcatgccgggcttaatacctgatgagttgataggtacagcaaaccaccatgrccacatgtttacctatgtaacctgcacatcctgcacatgtaccctggaacttaaaataaaaattataattaaaaaaagaattgagtagctgcaccactag

SEQ ID NO: 48623 - DNA, 201 bp, Homo sapiens
agcattaggaaaaatagctaacgcatgccgggcttaatacctgatgagttgataggtacagcaaaccaccatggccacatgtttacctatgtaacctgcamatcctgcacatgtaccctggaacttaaaataaaaattataattaaaaaaagaattgagtagctgcaccactagaaagatggcagtagcaagacagaagaa

SEQ ID NO: 48624 - DNA, 201 bp, Homo sapiens
cctatgtaacctgcacatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacga

SEQ ID NO: 48625 - DNA, 201 bp, Homo sapiens
cttgctgctagaacctcctatcctccctcaagccttttgctacctatcactctacacagtcttctagaatttgaatcctcaggaatccacagagcttcagmcatttacactgtttccagagatgtgctggcaaatgtttaacaacaatcagctctcactggttgatataagccagttccagcatactgctgaccatttttt

SEQ ID NO: 48626 - DNA, 201 bp, Homo sapiens
tctgctgacatgagttgttggagcttgaagggaattaataatgtactgcagtgactcctatcccaggaaaacttgttaaaaatacaaagcctcggctgggygtgatggctcacgcctgtaatcccagtactttgggaggtcgaggcgtgtggatcacaaggtcagaagatcaagatcatcctggctaacacggtgaaaccc

SEQ ID NO: 48627 - DNA, 201 bp, Homo sapiens
agaaaaggaaaagacatttaaaaagcctgtgtcttaatcagactcatcattttacatgtttgcgttttcaccttcacccctgccattaaaaattttttcaktctggtttcagctgctttaagcagtggaaatataaagtgtgttttactacacatggcagtatgattctgctgctcggtaatttcgagccaacatttgtat

SEQ ID NO: 48628 - DNA, 201 bp, Homo sapiens
  misc_feature (1)...(201): n = A,T,C or G, or insertion/deletion polymorphism (see Tables 1-2)
caggaatcctgggcttcggtgccagctctgccaatcactagctttattacctgtttctttatctattaaatgaggccaaggacccaagacctgcccacctnaccagggtatcagatgaagccctgatgagaagtcctttgcaaccgtgaaggaaactccaaatagcaccaagaggactcagaacacatggtttgacaacct

SEQ ID NO: 48629 - DNA, 201 bp, Homo sapiens
tggtgggaacttgcaaaacttacagtttctgcattgtagaagatgtcctggaatgaggggagacactggaagcagaaagaccgtggaagaggctgatacarttgttcagaagagcaacgtagaggcctgggctagggctatgactatggggccaactggagagacatgtcctagatagtgagagggtagtggaagggagga

SEQ ID NO: 48630 - DNA, 201 bp, Homo sapiens
cttggcaagttagttcttctctgagcttcagtttcctcatttgtaaaataggagtaataataatacctaaaggggtgttagtgagaattaaatgagatcayggatctgaaaaatgtttttaaaaatctgtgtggatcattatgtggtactttcaataataataataggccgggtgcagtggctcacacctctaatcccagc

SEQ ID NO: 48631 - DNA, 201 bp, Homo sapiens
agatctagacgcccccaaatccttgagatgtgggtatagctcagggtaagctgctctgaggtaaaggtccatgaaccctgccccactcctgtcagcccctyatcagccttttcagcaggttccagtgcctgacttgggataggactgagtggtaggaggagggggagtggaggggcatagcctttccctaattctgcctta

SEQ ID NO: 48632 - DNA, 201 bp, Homo sapiens
tgcagtgagccaagatcgagccactgaactccagcctaggcgactgagtgagactccatatcaaaaaaaaaaaaatacaaagcctcaacccctccttcccmtcaggcctcttgcatcagagtctctgggatggggcccaggaatctgtattctttcccagctccccagaatgttcagccaggtttggaaactgatctatcc

SEQ ID NO: 48633 - DNA, 201 bp, Homo sapiens
  misc_feature (1)...(201): n = A,T,C or G, or insertion/deletion polymorphism (see Tables 1-2)
cagttagggaatctgtagctctgggaagggaaggaacttgccccagtcacatctgatattagtgcttctttctccaatgaagagcctttaggctgggagtncagagacatgggttcaagtccaggctataccagtcatcacctcgggcaagtcatttcacctctccaagcctctgcttccttactgtgagaataatgccat

SEQ ID NO: 48634 - DNA, 201 bp, Homo sapiens
gttctttcagggaagcggtgttcttattcttattccaggaggtggggcggtatgggggttgaggggagaaacaaaagaagaacaagttctatagtagcctygggccacctgtgctctttccccagtgctctggtgctactgattgctcaagagaaggaaagaaacatatttgaccagcgtgccatagagaatgagctactg

SEQ ID NO: 48635 - DNA, 201 bp, Homo sapiens
gtctacaggttggtattttctgtgagaccattctttgcctcctgggacccacaagagctccacagagacccaattcaggcttataacaacctgggttttcygagtcctcacttcacttctttctcagggagcttgctgctagaacctcctatcctccctcaagccttttgctacctatcactctacacagtcttctagaat

SEQ ID NO: 48636 - DNA, 201 bp, Homo sapiens
cagaagtaataagttctgcttggacaagttgagtttgtttgggggccagtcatatgatgtctaagcagggagcctgcattaaatatttggaagttaacaattttttttttttttttgagacggattctcgctctgtcaccaggctggagtgcagtggcatgatcttggctcactgcaaccactgcctcccaggttcaagcg

SEQ ID NO: 48637 - DNA, 201 bp, Homo sapiens
aggttggggtggggacagaggctctcaggtctcctccaggcatatacaccaggggccaaggttagggcagcccagcatattccaacctgaagtggatcttkcaggaatgtgatgggaggatgctttttagtgctcagctgattctcagagtcatgttgctgtatatatgaggtcatgggcagaggggtcttccaggtccat

SEQ ID NO: 48638 - DNA, 201 bp, Homo sapiens
tttctccaggttcaatacgtaaaagtagaactgctgagtccaaaccacacctttttaaaacctcatccttagggaagaaaaaaaaataaaaaaataaaatmttttttaatttggtgactaggtaagacattttcatggttcaaattcaaatggtacaagagtttaccctaatgcagcttgtgttttggtttcttgttgatc

SEQ ID NO: 48639 - DNA, 201 bp, Homo sapiens
cctttcagatggcttattcataacaagtaactaataacaagtaaatatattccttggggcctcgctctgttgcccaggctggagtgtagtggcacaatctyggctcactgcaacctccgcctcctgggttcaagcaattctcccacctcagcctcccaagtagctgggactacaggcatgtgccactacgcctggctaatt

SEQ ID NO: 48640 - DNA, 201 bp, Homo sapiens
tcataacaagtaactaataacaagtaaatatattccttggggcctcgctctgttgcccaggctggagtgtagtggcacaatctcggctcactgcaacctcygcctcctgggttcaagcaattctcccacctcagcctcccaagtagctgggactacaggcatgtgccactacgcctggctaattttttttttttttttggt

SEQ ID NO: 48641 - DNA, 201 bp, Homo sapiens
tgtgcagatggacttcaacctgctagtggatgctgtcagccagaacgctgccttcctggagcaaactctttccaggtaggggacagtgaagcattgggggrccaggagctgccagagccaaggaactggaagattgcagagccgtgaggtgttactgtgtcagctgacttggtgggatagaggaaaggtacctccaaagaa

SEQ ID NO: 48642 - DNA, 201 bp, Homo sapiens
tgattagatgattgagatggggggtggtatttgaactagaccttaaaagacaaatagggaaaaggaacagcatagcaaggacccaaaagtaggaaaaggcaaaaaaaaaaaaaaaatgttcaagagaatgcagctgaaatgcagggcgcataagtggatatagtgggaaagaaggcaggccagcgtcagacagccgcgggg

SEQ ID NO: 48643 - DNA, 201 bp, Homo sapiens
gattgcttgagcccaggaatttgaggctatagtgcactatgatggcacctatgaatagccactgtattccagtctgggcaacatagtaagaccccactccaaaaaaaaaaaaaaaagatgctgagaagggtaatttagaaattatctaccaaaatttaaaatagatttacctgaattacttgatatttttacttttagaaa

SEQ ID NO: 48644 - DNA, 201 bp, Homo sapiens
  misc_feature (1)...(201): n = A,T,C or G, or insertion/deletion polymorphism (see Tables 1-2)
ctatgctgtgcagatggacttcaacctgctagtggatgctgtcagccagaacgctgccttcctggagcaaactctttccaggtaggggacagtgaagcatnggggggccaggagctgccagagccaaggaactggaagattgcagagccgtgaggtgttactgtgtcagctgacttggtgggatagaggaaaggtacctcc

SEQ ID NO: 48645 - DNA, 201 bp, Homo sapiens
tgccaagtgcccagacattgccacccagctggctgggactaagaaggtgcagcaggagctaagcaggccgggcatgctggagatgttgctccctggccagyctgaggctgtggcccgcctccgcgccacctttgctggcctctactcactggatgtggtacgtgggcagcctgtttctcctaccacaggcctcctaggtgg

SEQ ID NO: 48646 - DNA, 201 bp, Homo sapiens
ggaaaagccgaaaggaagggggtttcaggttgagggaaaagcagtgcaggccctgaggagggaaagagctttgtgatttgaggaatgacaggcctgtgtgrgtagaatggcagagactaggagtcagggatggtacaaggttgaaaaagtagacaggagccagctcctgaaggatcttgaaggccatggtagggagtatgg

SEQ ID NO: 48647 - DNA, 201 bp, Homo sapiens
gtaggtggattgcatgagctcaggagttcaagaccagcctgggcaacatggcaaaaccccatctctacaaataatacaaaaattagctgggtgtgttggcrtgcacctgtagtcccagctacttgggaggctgaggagggaggatcacttgagcccaggaggtagaagttgcagtgagccaagattgcgctgttgcactcc

SEQ ID NO: 48648 - DNA, 201 bp, Homo sapiens
cctaggtaggtggattgcatgagctcaggagttcaagaccagcctgggcaacatggcaaaaccccatctctacaaataatacaaaaattagctgggtgtgktggcgtgcacctgtagtcccagctacttgggaggctgaggagggaggatcacttgagcccaggaggtagaagttgcagtgagccaagattgcgctgttgc

SEQ ID NO: 48649 - DNA, 201 bp, Homo sapiens
  misc_feature (1)...(201): n = A,T,C or G, or insertion/deletion polymorphism (see Tables 1-2)
attttgctatcctaccatgtagtttcattagtttccacatccattatttcatttaaccctcacaaccactcggtgaggcatataattatccccattatacngatggagaaactaacgtttagagagatggagaggcttctctaaggccctacaggaagttcccaggttttctgactttcaggccgatggtattcccattct

SEQ ID NO: 48650 - DNA, 201 bp, Homo sapiens
  misc_feature (1)...(201): n = A,T,C or G, or insertion/deletion polymorphism (see Tables 1-2)
cccagcctgaaagccccaaattctctcctcctctacactttctggtcatctggccctgaccagcagcccttgccaacctgactggactgcactctgtatgnggtgggggtgaggagataatgaagatggagtttagaggtttatgggcgtcaaatgtcagggctgcggatcaaaacttattttccaaagggagtggaatca

SEQ ID NO: 48651 - DNA, 201 bp, Homo sapiens
gaggcagaggttgcagtgagcgaagatcgcgccattgcactccagcctgggcaacagagtgagactctgtctcaaaaaaacaaacaaacaacaacaacaamaaaaaccctcatctctatttatttattgggcactcaataattgttgaatgaataaatgcatgagagagaagatctcaggatgaaagaatggtaggagaga

SEQ ID NO: 48652 - DNA, 201 bp, Homo sapiens
ccactatacaaagaattggtgcagagctttgtaggtcaggggagcaagtacaaagaactcagggcaggagtgggtttggtgagtttgaggactaaaaaggwgaccaaggtaagcaaggatgaaattagatcagagaggcaggcaggcgccggatcgtggaccttagggtgaggagacggactttcctctaagaaaagggct

SEQ ID NO: 48653 - DNA, 201 bp, Homo sapiens
tggggtgacagagccacaccctgtctcaaacaacaacaataacacacagaacagatggtttcacattcttgcttaaaactctctagtagtgggctgggtgyggtggctcacacctgtaatcccagcactttgggaggctgaggcaggtagatcacctggggtcaggagttcgagaccagcctggccaatatgctgaaaccc

SEQ ID NO: 48654 - DNA, 201 bp, Homo sapiens
aaattagccgggcgtggtggcgcgtgcctgtagtcccagctagtcaggaggctgaggcaggagaatcacttgaacccgggaagcagaggttgcagtgagcygagatcatgccactgcactccagcctgggtgacagagtgagactttgtctccaaaaacaaacaaacaaacagtctccaagcaaatactgaaggtggtggt

SEQ ID NO: 48655 - DNA, 201 bp, Homo sapiens
gtctctacaaaaaatgctttgaaattagccaggcacagtagcatgcaccaaggatcgcttgacttgagcccaggagttggaggccacagtgagctatgacyatgccactgtactccagcctgggtaacaggaaaaaaaaaaaaaaaaaaaaaaaaaggcaggggttggtgaaatccaatgtagacaggtgtctttctacac

SEQ ID NO: 48656 - DNA, 201 bp, Homo sapiens
gaggcaggaggatcatctgagcctgggaaggttgaggctacagtgagccatgatcgtgccactgcattccagcctgggcgacagaatgagaccctgcctcaaaaaaaaaaaaaaaaaaaatcaatgtgtaattctctgaagatagataactcaagggtttcaagtactataaggtacaaaaaaggaaaggattcagagtgg

SEQ ID NO: 48657 - DNA, 201 bp, Homo sapiens
ccaggcctcaatctccaacctgattcctctgccagaggcagtggaatatgaagcaatggaaagagcctatcagctgggtgcagtggctcaggcctataacyccagcacattgggaggctgaggcaggaggatcacttgagcccaggagttcatgaccagcctgggcaacatagtgagacaccgtctctataaaaaatttaa

SEQ ID NO: 48658 - DNA, 201 bp, Homo sapiens
agaatcacttgaacctgggaggcagaggttgcagtgagctgagacagcgtcactgcactccagcctgtgtgacagagaaaaactctatctcattaggaagaaaaaaaaaatcctcatatacaaaatcctcccccaactaaactcttaataaaactttagactacaaacattagtttaaatgaatccagtttgttaattcaa

SEQ ID NO: 48659 - DNA, 201 bp, Homo sapiens
ggtagagaaaggactcctcccaagggtgcccatgcctcaaccagcaccaactgccagtgaagtttggttttatttggcaaatttctattggagcagtgaaygatctggggattggaaccagtcttgccatttcctggttgtgtggccttgggaaatccatgtctcaactctgagcctcagttttctcatttgtaaaataag

SEQ ID NO: 48660 - DNA, 201 bp, Homo sapiens
aatcctaagtcaatttcagctcaaccccaactcacaacgtgacactgggtgcctctccctgcacctcacctttcctatcagcacaatgagttggcttactkcatgtggctcttaaatttttttgaggctagcatagcacctatataagcccatctgctcctccttttgagtaggaaaagaaagctcaataccaaacaaaag

SEQ ID NO: 48661 - DNA, 201 bp, Homo sapiens
  misc_feature (1)...(201): n = A,T,C or G, or insertion/deletion polymorphism (see Tables 1-2)
tttttagcctaaatgtattttattatttttttgagatagagtctcactctgtcgcccaggctggagtgcagtggtgcgatctcagctcacttcaacctccncctcctgggttcaagtgattctcgtgcctcagcctcccgagtagctgagaatacaggtgcacatgccaccacacccagctaatttttgcatttttgtaga

SEQ ID NO: 48662 - DNA, 201 bp, Homo sapiens
ttcagccgggagccaagctgtggcctagactgcagatgcctgtcatatctgtggcttgtttccattcctcatgcggcaaacatgggctgaggctgttttgygccaggcgcatcctgggcaatgtggacatgggctgcgctgagtttcttagtgaaaatggagccctgatgctccctgtctttcccggttgcaggggaaatg

SEQ ID NO: 48663 - DNA, 201 bp, Homo sapiens
ggagaggatgctagggactgcagtagaagggattgggcttaccttctgggaagaaccaactaacgatgaaggaatgttgaaggggagatcctaaggaaccrctgtgatcacccagaagagggctttctctagccacagaggacaggataggagaaaccaagtcagagactgcagcaagagggatccaatctgtgccttaag

SEQ ID NO: 48664 - DNA, 201 bp, Homo sapiens
gggagaccccgacaccggtgaggcccgctgaccccgtccctgccctgccttgggaagtccccggtcttccttcttctgtgtcaagcatccacctccagctscatctccttaattcatccccatcttcttggatctctcccttcttctcccttgtctctgttaattatttggtgaggaagggggtgcatttctgccttggag

SEQ ID NO: 48665 - DNA, 201 bp, Homo sapiens
ccagggaagcggccactctctttcctgctgcccacagtggtccgacccgcggaggggctctgtggaacctacctcgctctgggggccaatggagctgcgcrgggcctcagcggcctgacacaggtgaggtttacgccatggttggcctttttcagccgggagccaagctgtggcctagactgcagatgcctgtcatatctg

SEQ ID NO: 48666 - DNA, 201 bp, Homo sapiens
agcagactgggagatcccgtctatgattctaccatcactgagagcatggatgacatgctcaggtgggtcttgggcaggacctgggggctacagaggcagcrgtgggtgtggggaaagggtcaggagaaaagcagctggtatagcaataaaggcctgaaatcctaagtcaatttcagctcaaccccaactcacaacgtgaca

SEQ ID NO: 48667 - DNA, 201 bp, Homo sapiens
cccctcccggctgtcgcgaagatcaggccccgccctccgccctcccactcccccgccgcagccacttccggcaggcgctgcgctgctggggggcgcgggcraggatggcggcggagaacgaggccagccaggagagcgccctgggcgcctactcgccagtggactacatgagcatcaccagcttcccgcggctgcccgagg

SEQ ID NO: 48668 - DNA, 201 bp, Homo sapiens
tctgctgatagcctgcagtgtgactctgggcaagccacagccctcttgagccttagttttctcaaatggcagaggaaactgaagaccagtgttctgagttsaagtcctggccctgcccttgacttgccatgtgaacttgaatgagtctctttgcctctcaatgtttcagtttccccatctggtgagggagttcagcgcagt

SEQ ID NO: 48669 - DNA, 201 bp, Homo sapiens
gatgtgtcatgatggatatcagcctgaagctaggccttttattcagtagtcaggagtgagacttctggtcctaatacagccctgactcaccaagcgacaayaggcacacctaccctgtcctgggccttagtttcctcttccagctcaacagagaatgcctgtctctcttgacctagagattggaactgcctgacatgtttt

SEQ ID NO: 48670 - DNA, 201 bp, Homo sapiens
taacctctagtgacagaaatcagatcagtggttggtggggctgggaggagctgactgggatatgacatgaaaaacctcctgggatgatggaagtgttgtcttttttttttttttatgagacggagtcctgctgtgtcaccctggctggagtgcagtggtgcgatcttggctcactgcaacctccgcctcccaggttcaagt

SEQ ID NO: 48671 - DNA, 201 bp, Homo sapiens
  misc_feature (1)...(201): n = A,T,C or G, or insertion/deletion polymorphism (see Tables 1-2)
ccatctaaaccaatatgtacataacatgtctctctaaatgaacttcctttttagcctaaatgtattttattatttttttgagatagagtctcactctgtcncccaggctggagtgcagtggtgcgatctcagctcacttcaacctccgcctcctgggttcaagtgattctcgtgcctcagcctcccgagtagctgagaata

SEQ ID NO: 48672 - DNA, 201 bp, Homo sapiens
gggaggatggcttgagcctgggaggcagaggttgcagggaggcagaggtttcagtgagctgagatggtgccactgcactccagctggggtgacagagccasaccctgtctcaaacaacaacaataacacacagaacagatggtttcacattcttgcttaaaactctctagtagtgggctgggtgcggtggctcacacctgt

SEQ ID NO: 48673 - DNA, 201 bp, Homo sapiens
ccattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaag

SEQ ID NO: 48674 - DNA, 201 bp, Homo sapiens
cattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaagc

SEQ ID NO: 48675 - DNA, 201 bp, Homo sapiens
attttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaagcg

SEQ ID NO: 48676 - DNA, 201 bp, Homo sapiens
tctggccacccacctttgtcatatacttggattcatgcaaatatttcagttccctgaatacctcaagctattttcggtgtgtgtgttttttttgttttttkttgttgttgttgtttttgagacagagtcttgctcttgttgcccaggctagaacgcaaatgtacgatctcagctcactgcaacctccgcctcctgggttca

SEQ ID NO: 48677 - DNA, 201 bp, Homo sapiens
cactaattgttaaaaaaagaatcaactgttcttactctagagctcttttttcctttctgctgatttgctggaagcactacaagacttctgtttgttcgttygtttgtttgtttgtttgtttttaaagatggggtcttgttatattgcctaggctggaatgcagtggttattcacaggcatgattataacacactactctct

SEQ ID NO: 48678 - DNA, 201 bp, Homo sapiens
cctgtaatcccagcacattgggaagatcacttgaggcaaggagtttgagaccagactggccaacacagcgagacccccatctctaaaaaaaaaaaaattartaagacatggatacaaccagggagggaggttataataatagagcatcctgttaatcagaatcatgggggagaacatacagcccagcgtgcctctcacttt

SEQ ID NO: 48679 - DNA, 201 bp, Homo sapiens
gaaatctaagctgcatgaacccgggtaggccccttcccagggccccagtttctgtgtccatcaaagaagctggagaataactcggaatgtatacagtgcartgctatttgccaagctctttcactgcctgttatttcaatctgttctcatggtaggcagagcaaacattgttattcccatttttatggaggttcagaatgt

SEQ ID NO: 48680 - DNA, 201 bp, Homo sapiens
tgcatgaacccgggtaggccccttcccagggccccagtttctgtgtccatcaaagaagctggagaataactcggaatgtatacagtgcaatgctatttgcyaagctctttcactgcctgttatttcaatctgttctcatggtaggcagagcaaacattgttattcccatttttatggaggttcagaatgtttaagtaagct

SEQ ID NO: 48681 - DNA, 201 bp, Homo sapiens
gcggtcggcagcgcgtgactgcatgcgacccctggcgcaagcgcaacagcccagccctagcttgggagcggacccacacgaactgctcaaaggcttggagsgggtctagtaaggcgaacggactgcttccggccagaggtcccgggcggaggaggaagctgtggctgccggcggtgggacgccccggccgctcagcccccg

SEQ ID NO: 48682 - DNA, 201 bp, Homo sapiens
  misc_feature (1)...(201): n = A,T,C or G, or insertion/deletion polymorphism (see Tables 1-2)
cggtcggcagcgcgtgactgcatgcgacccctggcgcaagcgcaacagcccagccctagcttgggagcggacccacacgaactgctcaaaggcttggaggnggtctagtaaggcgaacggactgcttccggccagaggtcccgggcggaggaggaagctgtggctgccggcggtgggacgccccggccgctcagcccccgg

SEQ ID NO: 48683 - DNA, 201 bp, Homo sapiens
tgaagtgcactgcccatccatgctccattccagttgattatctgcacatttatgttccagtagtactccgtaacctctgatttagttttcacatgctctartgtttgtcttccctggtaggctcctcaaaggtgggcactatgctccattcatctctgtatggctggcatcaagcatactgcttaatacatagtacatgtc

SEQ ID NO: 48684 - DNA, 201 bp, Homo sapiens
aactgtactgctgtcctgcagccactgaatcttggcataattcacaccatgaaagtactgtaccggagccaccttctaaaacagatcctcctcaagctcamcagcagtgaggatcagaagaggtggacatcaagcaggccatcgacatgattgctgcagcgtggtggtcagtcaagccatccacagtggtgaaatgttggc

SEQ ID NO: 48685 - DNA, 201 bp, Homo sapiens
gcctcccgggttcacaccattctcctgcctcagcctcccgagtagctgggactacaggcgcccgccaccacgcccggctaattttttttgtatttttagtrgagacagggtttcaccatgttggccaggatggtctcgatatcctgacctcgtgatccacacgcgtcggcctcccaaagtgctgggattacaggcgtaagc

SEQ ID NO: 48686 - DNA, 201 bp, Homo sapiens
  misc_feature (1)...(201): n = A,T,C or G, or insertion/deletion polymorphism (see Tables 1-2)
gccccgcctcacctttcagagccacgtcgggcgctgggaagcctacaataccaccctctcctcagcacgacgttcaaggcctgacctcagcctgtctcagnctttccctctcattcaggatcgggttcatacgtagtgccgcatcaagtagcgccttcatcactccagtgatctgccctcaatccgtctctcccactggcc

SEQ ID NO: 48687 - DNA, 201 bp, Homo sapiens
cacttggaaaggattcaggttgggtatctgccctccaactgtactgctgtcctgcagccactgaatcttggcataattcacaccatgaaagtactgtaccrgagccaccttctaaaacagatcctcctcaagctcaacagcagtgaggatcagaagaggtggacatcaagcaggccatcgacatgattgctgcagcgtggt

SEQ ID NO: 48688 - DNA, 201 bp, Homo sapiens
tctagacaggatacaccacaccattctccaaatacttcaatccctgtttcactcacttacgccaccatcctggcccctaaaggcatttgagtttgaagcayctatctagggtccaagacttaaatctggaaggaccttaggcatcatctgggcttgtggtttgcaaccatgggacttttcaaaaatatgtattaaaaaaaa

SEQ ID NO: 48689 - DNA, 201 bp, Homo sapiens
tccattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaa

SEQ ID NO: 48690 - DNA, 201 bp, Homo sapiens
tccctctactttatctacattcttaaaggatcgcaccaaatttgaagaaaaggtgcgggaggcatccgtgggaccccagcggaaaaggatgaggagcgctytttatgatgacattgataaggctgtttttgcttggtttcaagaaatccatgccaaaaacattcttgtgactggttctgtcattcggaaaaaagcactaaa

SEQ ID NO: 48691 - DNA, 201 bp, Homo sapiens
ggtccttgctacacagaaggctgtatagagggaggcagatgggaggattgcttgggcccaggagtttgagaccagcctgggcaacatagtgataccctgtmtcaaaaaaaaaaaaaaaaaaaaaaaagaaagaaagaaaggaccagcattatagaggtggttattagagtgttggcaaatgaatggagcctgggaaagaaa

SEQ ID NO: 48692 - DNA, 201 bp, Homo sapiens
cttttccgtgagaagagccttgaccaactaaagtccatttcagctgaggagatcttgactctcttttgtggggcaccacctgttacacctattattgtttkgtcgataattaatttttttgaaagattgtgtcttacttggatgttttttttcatgatgtgtgtggcagagagaacatataaacaggtcagtggagaaata

SEQ ID NO: 48693 - DNA, 201 bp, Homo sapiens
aagacaattttgtaagtttgcgcttcagtactgtgacagttatgtttactggacatagtcttttgggcaactatgatagatgcccaaagcatgaagcaaakatcttttattggaaatatgcaaattcaatacttttccattatagtctatagaactggagatttcatttctctatcaaagagagatcaagcgaactatttt

SEQ ID NO: 48694 - DNA, 201 bp, Homo sapiens
gtatggaaatgcttggatgtccaggcagatgtttgctgccggggcagggcactcatggtgaacctttgctagggcagtgtggaagggaaatgtggggtggrcacccgcacatagagttctcactggggcacttcctagtggagctgtgagaagagggccactgtcctcaagaccccagaatggtagatccaccaatagctt

SEQ ID NO: 48695 - DNA, 201 bp, Homo sapiens
cactccagcctgggtgacagaacgagactctgtctcaaaagaaaaaaaaaaagaagaaaagaaaaacccattttctggggagaaattcaaactggctgcakaaatttgcataagtagcaaggagcctaacattaatacccaagcaatggggaaaatgtttccaggacatgtcagacactttcatggcagcccctcccttca

SEQ ID NO: 48696 - DNA, 201 bp, Homo sapiens
agacaattttgtaagtttgcgcttcagtactgtgacagttatgtttactggacatagtcttttgggcaactatgatagatgcccaaagcatgaagcaaatmtcttttattggaaatatgcaaattcaatacttttccattatagtctatagaactggagatttcatttctctatcaaagagagatcaagcgaactatttta

SEQ ID NO: 48697 - DNA, 201 bp, Homo sapiens
  misc_feature (1)...(201): n = A,T,C or G, or insertion/deletion polymorphism (see Tables 1-2)
tttcaaaatgggaatacaagtaattctgaagtcctttcaaactgtaagatcgctctaattttagttggtaattattaattgataataaaactatcatatgnttgcaaaataactgattttctgactacattattccttctgtatttattagttatcactccaaggtagatctttcatttctttccctcttatttattcatt

SEQ ID NO: 48698 - DNA, 201 bp, Homo sapiens
gcattgaatggttagatgtttattgtagtcttcacagtctgggcttctttgtacctgtccttcttgggaaggctttccaagtatttgaggggaattgggcrttgtgatctaagtctttggtcactgcagctgtatctgcattagggggcaccctaagcccagtaatgttgtggctcctgcagacttgtagaggttactgcc

SEQ ID NO: 48699 - DNA, 201 bp, Homo sapiens
tctgtgagtgagtattttgtcattctacacccttacttagcaagctaaagtcctgaaaaatatgattcctgcattttcttgatttccagaataatatagcrtattccttaaaagaaagtggtttcatgaaaggtgttactttcaaaaaattaatcttcttttccttttttaaaaaataggattaaaagagtaaaattaata

SEQ ID NO: 48700 - DNA, 201 bp, Homo sapiens
catgtaagtgtacctataaatcccacctggttttcctagaactaacttattttggtgattttgttctcttagctgtggaaaattaaatcataagctgagttaaatgcctggactctcccctggctggtatcaaaacttacctatcaaggaaagtgatgactgcagaaaccagtgagatacccacctgcttgttcacatgca

SEQ ID NO: 48701 - DNA, 201 bp, Homo sapiens
catgagagctaaagggcatattatattatttggaaaattgtaactcagaggtgagcagagtagatggtggtggtgtggttttttcttttattttgattaayaaggcaattgtggtcatggaataactttcatatttatgttggtacttttctttgactgattatcctttaacgttttggagctgaatcctgttcacgagta

SEQ ID NO: 48702 - DNA, 201 bp, Homo sapiens
ggcaatggagctggctaagaggagtggagatgggagcctacgtagccctgggggaagcgagatggagagggcagctgcttggtgacttcctgtttttcacmaggtttctgtgagcattatctgtatgtttttcagtaaattccatcttactttgggcttgagtaaatttctttacttttaaatcaacaaatttaaaaacaa

SEQ ID NO: 48703 - DNA, 201 bp, Homo sapiens
ttttgttacccaggttctgatgattgctgatgtctgtcatattttatatatgtgtgtatgtgtgtgtgtgtgtgtgtgtgtgtgtgtgtgtgtatatatawaaaactacaaatgacatattgctcaaatccacctaaaaaaatcttagttagtagaaaagtaggtgagaacacgttatggattttttgaaggtagctcttt

SEQ ID NO: 48704 - DNA, 201 bp, Homo sapiens
tggagcctaaaacagaataaagaactgatccttaggattttctagtcataccagtggaatgagccacatgttttagggagctcacttgacataaagcaaakttattactttgaataatggttgccatatagttgtgagtggacacactgatagttaaagtagctgcaaatgcatttgtcttattttatttgtggtattttc

SEQ ID NO: 48705 - DNA, 201 bp, Homo sapiens
atttccaattttgttacccaggttctgatgattgctgatgtctgtcatattttatatatgtgtgtatgtgtgtgtgtgtgtgtgtgtgtgtgtgtgtgtgkatatatataaaactacaaatgacatattgctcaaatccacctaaaaaaatcttagttagtagaaaagtaggtgagaacacgttatggattttttgaaggt

SEQ ID NO: 48706 - DNA, 201 bp, Homo sapiens
tggtctttcctgtgctagtctcgtgatagtgaataagtctcacaagatctgatgggtttatcaggagtttctgcttttgcttcttctttctcttgccgccrccatgtaagaagtgcctttcacctcctgctgtgattctgaagcctccccagccttgtggaactgtaagtccaattaaacctcttcttcttctcagtctca

SEQ ID NO: 48707 - DNA, 201 bp, Homo sapiens
  misc_feature (1)...(201): n = A,T,C or G, or insertion/deletion polymorphism (see Tables 1-2)
cctggaagtggactcttccacagtggcatcaggggtaggggtcacagtggtggttaggaccagagctgaggtcacagagctcctggaggcaagattaaggncaaagagtggctccccatcaccaagttgggccatctggtcaaggacatgaagatcaagtccctggaggagatctgcctcttctctgtgcatcaaggacca

SEQ ID NO: 48708 - DNA, 201 bp, Homo sapiens
aaaaaaaaaaaaaaaaaagggaaaaataagtaagtaaataaatatgtcataccactctctcctagcctgtaaagtttgcactgagaagtctgctgccagamatattggagtatctttgtatgctatttgtttcctttctcttgctgcttttaggatcctttctttatctttgatctttgagggtttgattgttaaatgcct

SEQ ID NO: 48709 - DNA, 201 bp, Homo sapiens
aagagaaaagtaataaaaactgtacactttcactctgtccccttgctttttaactttttgttgtttgtatttatatcttattatactgtctatgtcttgawatgttgtattcttttaagttggttcatcttttagtcttcctattgaagatatgagtcgtttacacatgacaattacagggttataatattctgtcttttt

SEQ ID NO: 48710 - DNA, 201 bp, Homo sapiens
tttcctgtgctagtctcgtgatagtgaataagtctcacaagatctgatgggtttatcaggagtttctgcttttgcttcttctttctcttgccgccgccatstaagaagtgcctttcacctcctgctgtgattctgaagcctccccagccttgtggaactgtaagtccaattaaacctcttcttcttctcagtctcaggtat

SEQ ID NO: 48711 - DNA, 201 bp, Homo sapiens
gcagggatattgaatgttatcaaatgctttttcatcatcatttgaaatgattatatggtttttttccttcattcttttggtatgatgtgtcacgttaattsatttgtatgtatgttgaaccatccttgcatccctggtataaccctacttggtcgtgatgaatgatctttttatttatttattttatcttattgttactaa

SEQ ID NO: 48712 - DNA, 201 bp, Homo sapiens
cggttctatttctttaatgactgaacaaaatggtagcataggactttggtttggaatctggttttgccctcaaatcagaaagttcttgcatagtttatcckcagaatatgaagttaaactatacttgatttaaggtagtaatttgtcagtataattttctgtagggatatttttggcagaaatagaaagggtcttgaataa

SEQ ID NO: 48713 - DNA, 201 bp, Homo sapiens
aattaatgctaaatttaaaaatacatgaacacaaatacaattttttgaaaacaaaaaataaaaacaaaaaataaaagaacaaataagcaaaaaaaattttwaaataaaaatattaacatcatatcacagtactgttatataatttaaaattatatatttaaaagtataattcagaattatgaaagataaattttaaaaatc

SEQ ID NO: 48714 - DNA, 201 bp, Homo sapiens
ttcatttacattccatgccattattgataagtaaggacttactcctgccactttgttagttgttttctggttcatttgtgatctcttctttctttccttcytatcttcctcttagtgaaggtgattttctctaggggtattttaaaatttatttctttttattttttatgcatcttttattatttttttaatttgggggtt

SEQ ID NO: 48715 - DNA, 201 bp, Homo sapiens
cttacgatagctttggttattttgggtcttttgtgattccatataatttttatttttatttatttatttatttatttatttatttatttatttatttattwgagatggagtcttcctctgtcatccaggctggagtgcaatggcgcgatcttggctcactgcaacctctgcctcccaggttcaagcaattctgcctcagcc

SEQ ID NO: 48716 - DNA, 201 bp, Homo sapiens
gggagacccagtctctacaaaaataaaaataaaaaatcagctggatgtggtgacctgtgcctgtggttccagctatgctggaggttgagacaagaagatcrcctgagcccaggacgttgaggcagtagtgagctgtaattgtgacagtgaactccagcctgggcaactgagatccccatctcaaaaaaaaaaaaaaaaaaa

SEQ ID NO: 48717 - DNA, 201 bp, Homo sapiens
tattctgtgctccaggtactggtttccagcaaatattgagtgtctattctgtgctccaggtactagttttagatatagcggtgaacaaatcagacaaaacyccttgtcttcatggtgcttactttttagtggcaaatttatatttacattctcaagtcaacaagatctatagtttattgtctgggtactttcattattgtg

SEQ ID NO: 48718 - DNA, 201 bp, Homo sapiens
ttattcttaatagtttagaaaatatgggcatttgagatgaattacaaatcaagaacaaatgtatgtatgtgtttttttttaatacaatgctttttttttttactgttacctggagttgggccagacttcacaggtttagggcacaatcctctacaagactgctctcccttcagatatcagcctccagtttgggggtcccca

SEQ ID NO: 48719 - DNA, 201 bp, Homo sapiens
aaaaaaaaagaaagaaagaaaggaccagcattatagaggtggttattagagtgttggcaaatgaatggagcctgggaaagaaaaactaatggaggcaagarggcatggatagaaacaattttatatttttcttctcagaatcatttattctggcttcagaattcaagtccttcctctgatcgagttagtgcaataatctgg

SEQ ID NO: 48720 - DNA, 201 bp, Homo sapiens
ctcaaaaaaaaaaaaaaaaaaaaaaaagaaagaaagaaaggaccagcattatagaggtggttattagagtgttggcaaatgaatggagcctgggaaagaaraactaatggaggcaagaaggcatggatagaaacaattttatatttttcttctcagaatcatttattctggcttcagaattcaagtccttcctctgatcga

SEQ ID NO: 48721 - DNA, 201 bp, Homo sapiens
tgtagagacaaggtcttgccatgttgtccaggctggtctcgaattcctgagctcaagcagtgcttccaccttgtcctctcaaagtgccgagattataggcwtgagacgctctgcccagccatattcaatatttttattttcatggaatttatgacaaagtggttgagaataataaaaagaatccttctaataaatgcaaat

SEQ ID NO: 48722 - DNA, 201 bp, Homo sapiens
cgctctgcccagccatattcaatatttttattttcatggaatttatgacaaagtggttgagaataataaaaagaatccttctaataaatgcaaattacttwgtggcaaatactgagaagaggtctgtttacaagctactatacttataataagggaaataaatgagcctagttgctgggcatggtggctcatgcctgtaat

SEQ ID NO: 48723 - DNA, 201 bp, Homo sapiens
ctttgggaggctgaggcggggggatcatttgaggtcaggagttcaagaccagcctggccaacatggccaaaccttgtctctactaaaaatacaagaattawccgggcgtggtggtgggcacctgtaatcccagctactcgggaggtggaagcaggagaattgcttgaacctgggaggcagaggttgcagcgagtcaggatc

SEQ ID NO: 48724 - DNA, 201 bp, Homo sapiens
  misc_feature (1)...(201): n = A,T,C or G, or insertion/deletion polymorphism (see Tables 1-2)
tgatttgcatttctgtgatcaatgatatgagcaccttttcatatgcctgtttgccatttgtatgtcttcttttaagaaatgtctattcagatcttttgccngttttaaaatcagattattaggttatttcctatagagttgtttgagctccttatatattctggttgttaatcccttgtcagatggataatttgcaaagac

SEQ ID NO: 48725 - DNA, 201 bp, Homo sapiens
gcatatacccagcagtgagattgctggatcatatggtagttctatttttctttatttgaggaacctccaagctgttcttcatagtggttgtactactttayatttccaccaacagtgtacgggggttcccttttctccatatcctctccagcatttattattgcctatcttttggataaaagccattttaacgggagtgag

SEQ ID NO: 48726 - DNA, 201 bp, Homo sapiens
ctcattctgtcacccagggactggagtgcagtggcataatctcagctcactgcaaccctttgcctcctgggtacaagtgattctcctgcctcagcctcccragtagctgggattacaggtgcctgccaccatgcctggcaaatttttatatttttagtagagacagggtttcaccatgttgcccaggctggtcttgaactt

SEQ ID NO: 48727 - DNA, 201 bp, Homo sapiens
acgggggttttgccacgttggccaggctggtctcgaactcctgacctcaggtgacccttccgcctcggcctcccaaagtgctgggattacaggtgtgagcyacagcgcctggccttaatcaggacttctgtttatccctcagtaaacctttgcaggatttttttctttctttctttctttctttttttttaaatagagacg

SEQ ID NO: 48728 - DNA, 201 bp, Homo sapiens
ctgagtagctgggactacaggctcatagcagctactcccggctaatttttggcattttagtataagagacagggttttaccatattgcccaggctggtcgycctgaggtcagggaatctgcctgcctcagcctcccaaagtgctgggattgcaggcatgatcatatgtgtttcttgattcctcattttgctatatcacatg

SEQ ID NO: 48729 - DNA, 201 bp, Homo sapiens
accctgtcctgaaaaaaaaacaaaaacaaaacaaaacccaaaaaatggtagttcaaatacatgcactaatctctcctgaaacctctttaaaagtacaacarataagaaaaaatcatggcagcctgcaaggacttaaagaatggaagaagagactacagtaaatgagagctatcaatacaatttcgaaggttggaaaatgaa

SEQ ID NO: 48730 - DNA, 201 bp, Homo sapiens
ggtagggctgaggtggtaatttgagcagtggggagtggatgtaaatacagataaagcttcccttgttctctcacctgcccctcacctcctgctgtgcaacytggttcctaacaggccacgtaccactattccatgccctgggggttggagacccctgatatagtccataaagcctaaaatgccatctggctctttatagaa

SEQ ID NO: 48731 - DNA, 201 bp, Homo sapiens
tagcaaagtgagtgcaattcatgcaggaaatgtaatatccaactaatagatgttccagaaaaaggaaatacatggagaagaagaaattaataaataatttwaaaaattgccccagaaatgcagtactgtgtatgtatttccagattaaaaggatcttttcgttgggcatggtggctcacgcctgtaatcctagcactttgg

SEQ ID NO: 48732 - DNA, 201 bp, Homo sapiens
attagaaagtgagaagactagaaaataaaaataatcagaataaattcaggggtggctgggtacagtggctcacgcctgtaatctcagcactttgggaggcygaggctgatcgcttgagcccaggagttcaagattagcttgggcaacatggtgataccctgtctttacaaaaaatacaaaaaaattagctgggcttggcgt

SEQ ID NO: 48733 - DNA, 201 bp, Homo sapiens
actgcaacctccgcctcccaggttcaagtgattctcctgccttagcctcctgagtagcggggattacaggcacctgccaccatgcctgactaatttttgtrtttttagtagagatagggtttcatcatgttgaccaggctggtctcaaactcctgacctcaggtgatccacccgccttggcctcccaaagtgctgggatta

SEQ ID NO: 48734 - DNA, 201 bp, Homo sapiens
  misc_feature (1)...(201): n = A,T,C or G, or insertion/deletion polymorphism (see Tables 1-2)
aaaaagctcagctaagccaattgagtgggtcatcttggtgtgcttacaggaatcactcccctcccagaacaccttagttgatcagttccataacatggcantagcttcttagagggagtactgcttgctagagacatcagagtttaacatttaaatattaaaatctattattggctggacatggtggctcatgcctgtaat

SEQ ID NO: 48735 - DNA, 201 bp, Homo sapiens
attttttccattgttcagcaattggtggattcaggttacctctttaagaatctttgtttggctgttactactttatttcatgcaaggtaattggagaaatkggaataagcaatgacagtttctttttgctgcttttgctattaaataatgaagacctactgattttacatttaccctttcatttgacagtttaaagtacac

SEQ ID NO: 48736 - DNA, 201 bp, Homo sapiens
taaatacttctggagctggaatgcttgttatttaatgatacagcttattccacttctggatagattgaatgatgaagaaatagttcacttatcaacctttyagttgcttaatgtcaatgattgttatgattcttaggtttttgttctttaggctaaatatttccacattgtcttgcaaatagtggatgatggatatatatt

SEQ ID NO: 48737 - DNA, 201 bp, Homo sapiens
ttgccaaagcaaaacctgaaattccatggacatctctgactcggaaggggcttgttcgagttgtattttttccattgttcagcaattggtggattcaggtyacctctttaagaatctttgtttggctgttactactttatttcatgcaaggtaattggagaaatgggaataagcaatgacagtttctttttgctgcttttg

SEQ ID NO: 48738 - DNA, 201 bp, Homo sapiens
tactggggaggctgagacaggagaatggcgtgaacccggggaggcagagcttgcagtgagccaagatcgcgccactgcactccagcctggacgacagaacsagactccgtctcaaaaaaaaaaaaaaaaaaaaaaaaaaaaaaaattacagtaacaaatgaatgtggcaaggtcttcaaatacaagatcagtacacaaaaa

SEQ ID NO: 48739 - DNA, 201 bp, Homo sapiens
gagtgataattctaaaatacaaatctgataatgccacttcctttaaaatccttttttcttctttctggattgcttgcttctgttcctttatttgttctaakacagtctcatctctgaccattccctccctcctcctcacatggtgaacttcgactcaactaaccttctttgtttctgatgtgtaccaggcctcatgtgcct

SEQ ID NO: 48740 - DNA, 201 bp, Homo sapiens
gctactggggaggctgagacaggagaatggcgtgaacccggggaggcagagcttgcagtgagccaagatcgcgccactgcactccagcctggacgacagarcgagactccgtctcaaaaaaaaaaaaaaaaaaaaaaaaaaaaaaaattacagtaacaaatgaatgtggcaaggtcttcaaatacaagatcagtacacaaa

SEQ ID NO: 48741 - DNA, 201 bp, Homo sapiens
atcaggcattagattctcataaggagcatgcaacctagatccctcgaatgtgcaggtcacagtggggtttgcactcctgtgagaatctaatgccgccactkatctgacaggaggtagggctgaggtggtaatttgagcagtggggagtggatgtaaatacagataaagcttcccttgttctctcacctgcccctcacctcc

SEQ ID NO: 48742 - DNA, 201 bp, Homo sapiens
gcagaaatttgcataagtagcaaggagcctaacattaatacccaagcaatggggaaaatgtttccaggacatgtcagacactttcatggcagcccctcccytcacaggcctggaggcctaggaggaaaaagtggtttcgtgggccggacccagggtccccatgctgtgtgcagccttgggacttggtgtcccatgtcccag

SEQ ID NO: 48743 - DNA, 201 bp, Homo sapiens
tcacacttagtggttaagactgaatgttttcccctaaaatcaggaacaaagcagggatatctgctcttactatttttatttaacattgtactgggagtccyagccaatgtaataagcaaaggaaaagagatgaaaggcattgagatggaaaggaatatgaaaactgcctttactcatgacagcataatcccatatttagaa

SEQ ID NO: 48744 - DNA, 201 bp, Homo sapiens
atttatatcttattatactgtctatgtcttgaaatgttgtattcttttaagttggttcatcttttagtcttcctattgaagatatgagtcgtttacacatracaattacagggttataatattctgtcttttttgtgtatttactattactaatgagttttgtaccttcagatgattgcttattgctcattaatgtcattt

SEQ ID NO: 48745 - DNA, 201 bp, Homo sapiens
gaagcaaccttggagatcatggactatctctcctcataacagaagacatttagtctctctctagatgagagaatggcttagtaaggaaaaatggacctagygagccatggtggtatgtgcctatggtccttgctacacagaaggctgtatagagggaggcagatgggaggattgcttgggcccaggagtttgagaccagcc

SEQ ID NO: 48746 - DNA, 201 bp, Homo sapiens
  misc_feature (1)...(201): n = A,T,C or G, or insertion/deletion polymorphism (see Tables 1-2)
aaagctgtccaccaagttgttgaaagtaagtcataggctatgatacacttttactatcatttgagttaaatcagtcttttctctaagaaaacattaaatgncagatgataccttgggttgggaggggtcctggaagtggactcttccacagtggcatcaggggtaggggtcacagtggtggttaggaccagagctgaggtc

SEQ ID NO: 48747 - DNA, 201 bp, Homo sapiens
tagaattaattttaaagaagagctctaatgttttacatcttaaaacctcttcttttcagttatagcaattgtcttatatttgatgatgcctattgtgaacrtaagtgaagtacttggacccttgtgccttatgctactcatgggaactgtccactgtcaaattgtgtctactcagataacaagaccatcaggaaacaatgg

SEQ ID NO: 48748 - DNA, 201 bp, Homo sapiens
aaatgaatggagcctgggaaagaaaaactaatggaggcaagaaggcatggatagaaacaattttatatttttcttctcagaatcatttattctggcttcaraattcaagtccttcctctgatcgagttagtgcaataatctgggaggggaatgagtgcaaaaagatggatatgtctgtgttggaaataagtggcatcatca

SEQ ID NO: 48749 - DNA, 201 bp, Homo sapiens
ctatgtaatgtgctttggaaacaacagggtaacgagctattaatgaaaattttcactgcccatcttactgaacactgattagaacttcattctttttaatrtttttgtattctgggaatatcgttggcaattatatgaatacacagacacatacatacatttcactgtgattttttttaaatctcttctagagatttttat

SEQ ID NO: 48750 - DNA, 201 bp, Homo sapiens
agtttgaggccatgcgtggtcgctcacgcctataatcccagcactctgggaagccgaggtttttgctcgaggccgggagtttgggaccagcctgggcaacrtagctctacaaaaagataaaaaaattagctgggtgtggtgggcatgtgcctgtagtcccagatactggggaagctggttgggggggatcgcctgagccca

SEQ ID NO: 48751 - DNA, 201 bp, Homo sapiens
gtagttattagaggtggggaagtataagagggaggcaatgacagatagccaacggttggttaacaaatacaaaagtacagctagataggaataaggtttaktgttctgtagcactgtaaggtggctataattaacaatttattatattttttcagatacctagcagggtggattttgaatgaacccaacacaaagaaatga

SEQ ID NO: 48752 - DNA, 201 bp, Homo sapiens
tgaactcctgacctcgtgatccacctgcctcggcctcccaaagtgctgggattacaggcctgagccaccgcgcctggccaagtatttcttcattattctgytttcccacattttctctcatgctttcttgtttatcctttccaaaataggttagcattattttatcgtgattaaaaccaaaagaccccccaaaaccaacaa

SEQ ID NO: 48753 - DNA, 201 bp, Homo sapiens
aatcccttgtcagatggataatttgcaaagactttctctcattctgtgagttgtctcttctcttggttgattgtttcctttgctgtgtagaagcttccctyggcccggccctccgccccgccatccctgagacggagtcttgctctgtcacccaggctggagtgcagtgttgtgatcttggtttatcttgatgtgacccca

SEQ ID NO: 48754 - DNA, 201 bp, Homo sapiens
tagatgtgatcaaaattacattgtatgaaattattacattaattcacttgagtcaacaaatacttaagcttattgtgtctgtgccaaatattcttctaaaygctgagataaattttctacttttaaatgtcaaattcactttggtagtatttcaatcatttatccaacaaatattgagtgtctattctgtgctccaggtac

SEQ ID NO: 48755 - DNA, 201 bp, Homo sapiens
ctccttgatgctgagaaaaccttgttacaaacttttagttccagtttgggatttttgtcattcagtacagttgtttaaaaggaaaatttctatactatatkattctttataaaatttatcatatattggcttcaaagaaaacattctctttgaaattcagtcttaatcaaaatttggtgaaaattcactgtaaacaaggat

SEQ ID NO: 48756 - DNA, 201 bp, Homo sapiens
cgccaccatgcccagctaatttttgtatttttggtagaggtggggtttcaccatgttggccaggatggctcgatctcttgatttcatgatctgcctgcctyggcctcccaaagtgctgggattacaggcgtgagccaccacgcctggccccttttactactctttagcatactgtttgagatacatttgctaagatgagca

SEQ ID NO: 48757 - DNA, 201 bp, Homo sapiens
caggtgtgagccacagcgcctggccttaatcaggacttctgtttatccctcagtaaacctttgcaggatttttttctttctttctttctttcttttttttwaaatagagacggggtctcactcttactcccaggctggagtgcagtggcgtgatggtatttcactacagccttgagcccaggcaatcctcctgcctcagcc

SEQ ID NO: 48758 - DNA, 201 bp, Homo sapiens
attttaaaaactttttaaaaaagatttcttgtaaattcagttaaattaatggaatgttttctaaggaaataaaatgctatgctatgtcttattgatatctrtagtatatatcttttgtctaggatatcaataaaaagtgatcagttgctactattctatgttacccttataaaatgtgccataagaggtagattcctaaca

SEQ ID NO: 48759 - DNA, 201 bp, Homo sapiens
ttgagtgtgggaggcagaggttgcagtgagctgagatcatgcattgcactccagcctgggcaacaaaagcgagactccgtctcaaaaataaaaaaaaaaaagaagaacctaattaagaaggtcagataagcttttgctaaggaattgattaaaatgagatctgaagcatgagtagcagttaattaggtcaagaacaaatac

SEQ ID NO: 48760 - DNA, 201 bp, Homo sapiens
ttagtagagacggggtttcaccatgttagccaggatggtctcgatctcctgacctcgtgatccacctgcctcagcctcccaaagtgctgggattataggcmtgaggcatgagccaccgcgccctgcctgatttccttcactcttttccatgtcatttaatacataccttccttttagtgcatgatatcaaagttatttgtt

SEQ ID NO: 48761 - DNA, 201 bp, Homo sapiens
  misc_feature (1)...(201): n = A,T,C or G, or insertion/deletion polymorphism (see Tables 1-2)
ggggtttcactgtgttagccaggatggtctcgatctcctgaccttgtgatctgctcacctccgactcccaaagtgctgggattacaggcgtgagccaccgngcccggcctagagtatggttttaagtttttcaggttcttaaacttttttctacacagctcttagaactgagaggattcttattttatactaaccaagtga

SEQ ID NO: 48762 - DNA, 201 bp, Homo sapiens
tctgataggattctgaattccttctgtgtattcttgaatttgtttgagtttcctcaaaatagcttttttttttttttttttttttttttttttgagacagrgtttcactgtcattgctcaggttgaagtgcaatggtacaatctcggctcactgcaaactccacctcctaggctcaagtgatcctcctgcctcagccttcc

SEQ ID NO: 48763 - DNA, 201 bp, Homo sapiens
acctcggcggcgaaagccggaaagcggaagccgaaggctgctgcccggtggtcggctgagcggctctagcccagatctcagacggctgagtcactgcatcycggcgcggcccgcagaagacgagcgccgctgccgcctcctcctcccgggctcccgggctctcggggtccggggcctttgcacctgtcttttccagctggg

SEQ ID NO: 48764 - DNA, 201 bp, Homo sapiens
gaggaatagaaactttggaatctgtacccattattggtggtttttgggagactatctttggcaacaggtgggagtcttttttacttgattttgtattcacrtagtgtttacagaatgtatagtatcatcaggccataggagtaagtagtatagacttatcttggtgtgatttttaagggttatcagagggcttgcttactc

SEQ ID NO: 48765 - DNA, 201 bp, Homo sapiens
ttactgaacactgattagaacttcattctttttaatatttttgtattctgggaatatcgttggcaattatatgaatacacagacacatacatacatttcaytgtgattttttttaaatctcttctagagatttttatttgcaaaactcttcagccatattacttctgccaggaaagctaggaaatatgaaatacctcattt

SEQ ID NO: 48766 - DNA, 201 bp, Homo sapiens
tgactgaacaaaatggtagcataggactttggtttggaatctggttttgccctcaaatcagaaagttcttgcatagtttatcctcagaatatgaagttaarctatacttgatttaaggtagtaatttgtcagtataattttctgtagggatatttttggcagaaatagaaagggtcttgaataatctgaagttattgaaat

SEQ ID NO: 48767 - DNA, 201 bp, Homo sapiens
ttttttaaaaaataggattaaaagagtaaaattaatatctaacaaagggactgaaactgacaatgacccaagttgtgtccatcctatcattaagaggagamaatgtcgaccagagattagaatgtggcaaacaagagagaaagcaaaattttcagatggagaaaagtgccgtagggtaagatttagatggatttaacaagg

SEQ ID NO: 48768 - DNA, 201 bp, Homo sapiens
agcattttatttaaaaaaatcattgccaaacctaaggtcacctagattttctactgttgtcttctaagagctttatagttttgcatttacatttaggtctrtaatccattttgagttaatttttgaaaggagtaaggtctatgtctagattcatttctctttttttttatgtggatgtccagttgtactagcatcatttgt

SEQ ID NO: 48769 - DNA, 201 bp, Homo sapiens
ctttgctcaacagacaagatttgggaaaaaaagatataaccatcaccctggagttacgtaagtactgtggccttgccttcaaagacttacttttaactgtratatatagtcataaaattactggggtgtgtttttcagggactatatggatcgtttagtagatgaaacagaagctttgggtgggacggtaaatgcttcagc

SEQ ID NO: 48770 - DNA, 201 bp, Homo sapiens
cagtaatgaatgagttctattgctctacatcttcaccagcatttcgtggtgtcagtgttttggatttcaccactgtaatagtttttaatgccatctctttwttgttttaatttgtaattccctcatgaggatgatgttgaccatcttttcttatgcttatttgccatttgtgtgtttttttttcaggtgttcattcagatt

SEQ ID NO: 48771 - DNA, 201 bp, Homo sapiens
attagccaagtttgctgggaagaaaatgtttttcccagtgtaatgtatgaggcaggttgttggagacactttcttcacgtggctcagactgcggtccagcwgctcagggcactgtttcatggttctgtccacagcgcgtgctcactgcgtcatttctaaagttattcacttgtacttaatttcaagccatttttttttact

SEQ ID NO: 48772 - DNA, 201 bp, Homo sapiens
tgtgtgtgaaaggccctacttaacggataatcggattactggtgtcttcaaagttatttacttgtcccactggatagccaatcaaggaagacaaagaattrtttgtgtacatctttgagtgcgttcatgatttttaatgtgttaatgggattttctttatcagtatatgaaaacgaagaccagttactttggtgtcctgat

SEQ ID NO: 48773 - DNA, 201 bp, Homo sapiens
tacagactttgagacttactcccactaagttcctcccactaagactgaattccttgtgagcagggattcttcagtaaatttcatttgtatgtccagtagckagtagctagtagccctcagccaagcacttagaactgagtaaatgatgggaaggtggaccatcagtgcataaaaggtgaaaattgccactccccatttcag

SEQ ID NO: 48774 - DNA, 201 bp, Homo sapiens
tccatgtctttatgatgtttagaaatagttggagtgatttttccctaaaatttccataagtaaataacttttacccgtggcataagcttgattttgagatrccttggcaaaaaatttgaaaataaccctctccctacctccagtctccagcctcatcctcagtatgcactccagcaataagggaattggagggaccccagg

SEQ ID NO: 48775 - DNA, 201 bp, Homo sapiens
aaatgataagcaagtttgactttttctattagaatgtttctttaaaaccatgctgcttaaatcactttgttgttatcataagttgttttcttgtggactaraccccttataaaagtgtttgtgaataactttgccttgttattttgctgatttagacatattttcagaatcatggggtcttaatttataacctataaatta

SEQ ID NO: 48776 - DNA, 201 bp, Homo sapiens
aaatctcttaattgatggatacagaaatcttaaaaatgtttaacagattaactagttcgtgagtatattgttttgaggttatttattcgaatgataaatarttctttttttgtatttttagtagagacggggtttcaccatgttggccaggctggtctcgaactcctgacctcaagtgatctgcctgcctcggcctcccaa

SEQ ID NO: 48777 - DNA, 201 bp, Homo sapiens
ctgatcacatgtgggatgggggatgggaacattgcctattaagcttttcgaatacccctaagttttgcccctctgacatcattctgcttctttcatatgcrtttatcactgagaatcaccaaccctgactaataagtattcagaggtaggcagacacaaacttgaattctgaagtaacatagggaagtcatactagctgtc

SEQ ID NO: 48778 - DNA, 201 bp, Homo sapiens
  misc_feature (1)...(201): n = A,T,C or G, or insertion/deletion polymorphism (see Tables 1-2)
caagttcccttcttagaaacgaactgaaaccttttttgaactgtgagaactctctcttttttaaagttaccatgcagatcatctttcttttgttaagaatnttttgtttaggcaaaacttactatgatcagttagctttctcagagagtggccattcattccaacaaaaaatatttaattgaatatcacgcaggagaagta

SEQ ID NO: 48779 - DNA, 201 bp, Homo sapiens
gaaatatttcataataataatttttttaaaaaatgaaactttaaaaaatgccttaggaaagtgccacattgaaagtgaatatacagcctcccaaaaagtcygatgcagccaattttccttcagtattgggtgtttctttagttgaacaccagatgatgaagttggcttgtatttacagaccatgctgtaccaaaaaaaaaa

SEQ ID NO: 48780 - DNA, 201 bp, Homo sapiens
gaggcaggttgttggagacactttcttcacgtggctcagactgcggtccagctgctcagggcactgtttcatggttctgtccacagcgcgtgctcactgcstcatttctaaagttattcacttgtacttaatttcaagccatttttttttactttgaaaactctgaacgcctcattgaggacagtacatacaatgtgtgcc

SEQ ID NO: 48781 - DNA, 201 bp, Homo sapiens
  misc_feature (1)...(201): n = A,T,C or G, or insertion/deletion polymorphism (see Tables 1-2)
gagaaaatcctgtttttttataaatttgatttcatttctttgggattatggattttagtcatttcttctcttggtttttggagtttcctattgacttcatntttgctattaaaagatattatagttttataaacaagtatgaattatccaaaacaacttgcaatggatatatcttccaaaaccttcagatgtgattttctg

SEQ ID NO: 48782 - DNA, 201 bp, Homo sapiens
atagttttcttaattaatgagatgtaatcatttctaactgtagcactgccttcttattcttccaggaggaaatagcaaaagacctgttgtcaggtgatgaygaggaaactcagtcttctgcggatgatctgacgccatctgtgacttcccatgaaacttctgatttcttccctaggcctttacgatgtaagaaacccagtg

SEQ ID NO: 48783 - DNA, 201 bp, Homo sapiens
ttggcagctgcggaggagcgctcgactccgcctcctctgcgccctgttgccggcgctgcctctttccctggctgtgcgatctaacctcacgttttcttctstctctcctaggcttcttttggaagttcgagcccaggtttgtcctattttcttacgtcttcggtggttcccagtgggtaatgtgggctcaaaggtctgttg

SEQ ID NO: 48784 - DNA, 201 bp, Homo sapiens
  misc_feature (1)...(201): n = A,T,C or G, or insertion/deletion polymorphism (see Tables 1-2)
atgattttgaccccactgctgagatgttggtccatgactatgatgatgaaagaactcttgaagaagaggaaatgatggatgagggtaaaaacttcagttcngaaattgaagacttagaaaaggtataagatttactttaatatacaaacttaacaaagattttgaaattctgttgtaattttaaaaataatctacctgaaa

SEQ ID NO: 48785 - DNA, 201 bp, Homo sapiens
  misc_feature (1)...(201): n = A,T,C or G, or insertion/deletion polymorphism (see Tables 1-2)
taagggtcaaacttgaatttgtataagtactgtagtagatacagagagaagccttttccttcaaataactcataatctagtggaatattttaagaaaattnaaaaagatttactgtattttcaaatataaattggtaatatcccatcccctgctcctttaaaagtcatctttgaaaaggttggcaagagtgagtgtagttt

SEQ ID NO: 48786 - DNA, 201 bp, Homo sapiens
aagttttggtgcaaatgatgtgtgttttagcatcagccctctggccacccgtgtcatcccttgaacttattaatgcagtttctacggagatggtcatcttstccctcaacagatggtcattcctgtgtctttatagaaaagcggggttttcttgagtggatgctgggaacctcctgtctccctcacatgtacaaactttta

SEQ ID NO: 48787 - DNA, 201 bp, Homo sapiens
cttgtcccaggtcaccaataattcctgattgccagatactaagatttcttgtctttctcttgctcagtttctttttggaatttgacccaagtgaccattcrtgattatccatacttgtttctgccttaatttaagtaatcctactttttcctcgttctattttctggcttctccctctttcttattttatgatcttttctt

SEQ ID NO: 48788 - DNA, 201 bp, Homo sapiens
aagtgggccccgagtgttactctgtatctcagggctctatttgtttgttacactcatcaaacttggcagccctatatttgtgtattgtcaaaagccttgtratctttcaagacttagctcagtcttcaccctctgtgcatacctccatactccataccagtattcttggggtgtaggtctgcccttgtctatagtcacaat

SEQ ID NO: 48789 - DNA, 201 bp, Homo sapiens
ttagataagctctctgcatacccacaaattaggcaattgttttagtatatggttgcactgattatcatttaatagtatattattgaatattatataatatmtaatattaaatatttatgtacatgaagtaaatcataggagaatttcatatttctctcataaggttccaactgcttcttaatgatatgttataaaaagata

SEQ ID NO: 48790 - DNA, 201 bp, Homo sapiens
tctgtaaataacctgggtgtggactttgaaaatcacacacatcacatcaccagtgccaaaatggctgtttctgtggctgactttggcagtctctctgccarcgagaccaatggtttcatcagtgcccatgctctgcatcagcacgcggccctacactctgagtgacctgagtgaggatcccggaactgcgtgtgcagcacc

SEQ ID NO: 48791 - DNA, 201 bp, Homo sapiens
ggagaatttcatatttctctcataaggttccaactgcttcttaatgatatgttataaaaagatagttttcttaattaatgagatgtaatcatttctaactstagcactgccttcttattcttccaggaggaaatagcaaaagacctgttgtcaggtgatgacgaggaaactcagtcttctgcggatgatctgacgccatct

SEQ ID NO: 48792 - DNA, 201 bp, Homo sapiens
tctgtatctcagggctctatttgtttgttacactcatcaaacttggcagccctatatttgtgtattgtcaaaagccttgtcatctttcaagacttagctcwgtcttcaccctctgtgcatacctccatactccataccagtattcttggggtgtaggtctgcccttgtctatagtcacaattgaatattgaagccatcaca

SEQ ID NO: 48793 - DNA, 201 bp, Homo sapiens
  misc_feature (1)...(201): n = A,T,C or G, or insertion/deletion polymorphism (see Tables 1-2)
cattgacttggaagttccaattgggtatgcttgcacagctatgtcagcctgatgcatccatctcattttaagaatggccctgactcacaggctggatatangttcatgtatatggaccaagttcccttcttagaaacgaactgaaaccttttttgaactgtgagaactctctcttttttaaagttaccatgcagatcatct

SEQ ID NO: 48794 - DNA, 201 bp, Homo sapiens
  misc_feature (1)...(201): n = A,T,C or G, or insertion/deletion polymorphism (see Tables 1-2)
agaaaaaagctgggagaagagctctggtgtctgagatcactctctccaaattcctgtagggtcctgctataattcctgatggtatttgcatctcacttatncatgtaccttacagccgactttcttttccacagatagaattggcctcccactttaggacaatgtgtcctccaaatttgctagggcaactccataccttac

SEQ ID NO: 48795 - DNA, 201 bp, Homo sapiens
aagaatgctagtgtttaagattttcagtgaaggtgtaagataatttctggatacacacttgttttataaactaatacattctgatttttttaaaaaaaaaaccttgggctttcgaaaatggcctcattattaaatgtaaaggcattccactaatcaaagtgttcagaactttataatttattaaaagtgttcagaactata

SEQ ID NO: 48796 - DNA, 201 bp, Homo sapiens
ttccaagtttggcacagaaaaagggtgattttgacttctgagctgagacgatcttaggtcatctagtacagtgtttcttaactttcctgaggtcagaaacycctgtcaggatctaatgaaagcaagggatgtgtcccagaactctgcacatatgcataattacacacaatctggggtttgtagaatccctgtagcaggtcc

SEQ ID NO: 48797 - DNA, 201 bp, Homo sapiens
agtttcaggtttacagcaaagttaaccagaaagtattgagttgccttatgtcccttccactcctatagttattattatatcttttattattaatagtgtgrtacatttgttaaaattaatgagccaatattgatacattattattaattaaagtccatagtttacattaaggttcgctcttcatgttgtacattccattga

SEQ ID NO: 48798 - DNA, 201 bp, Homo sapiens
cttgtcttactgcattagctagaccttccagtattgatgttgaaaatttcacactttctgtatgtttgaaaatctaatgtttctcaaagatgagataaagygtataatttaagacatttttaaagaagtctggattgtccttttaagtaaaaaaaaccatcagttttgtaatgacttatgaaatttactctatccattcat

SEQ ID NO: 48799 - DNA, 201 bp, Homo sapiens
  misc_feature (1)...(201): n = A,T,C or G, or insertion/deletion polymorphism (see Tables 1-2)
attgtcaagattgtaatcttaaaaatcataccagtcattgataatttagtttatcctgaggcagtcgacttgcagaggcacagtctacaaagcctaggatnttgccactcaatggtttacattttgggacatcttttaagttgtttgtagcactgcagttcaaagtgttaatatttagagggacttctagattttatacct

SEQ ID NO: 48800 - DNA, 201 bp, Homo sapiens
ccagctgctcagggcactgtttcatggttctgtccacagcgcgtgctcactgcgtcatttctaaagttattcacttgtacttaatttcaagccattttttyttactttgaaaactctgaacgcctcattgaggacagtacatacaatgtgtgccaaggtctggtttcaaagtttagctgtttttgagttatttgactggac

SEQ ID NO: 48801 - DNA, 201 bp, Homo sapiens
tacctgtagattcagaatactctcctgatcacatgtgggatgggggatgggaacattgcctattaagcttttcgaatacccctaagttttgcccctctgasatcattctgcttctttcatatgcctttatcactgagaatcaccaaccctgactaataagtattcagaggtaggcagacacaaacttgaattctgaagtaa

SEQ ID NO: 48802 - DNA, 201 bp, Homo sapiens
cagtctgcatgtactgaatgttacgttgtgcatggtaacacttattttcacatggattcctagaggggaacagtgacttggtgtcactgtgaggcatggcrtaggtattcataacataggcagcactgtagccagggtatgtaattttattaaagcagtgcagccagtgagataacttggggaactgggattcaaacccag

SEQ ID NO: 48803 - DNA, 201 bp, Homo sapiens
tttgtgttccccactgccctcactcccaattttaaaacctgtagacagaggccaccagctcaaaaccagcacagatgttctgaactgaatggtgtggcctstttttgtgtaaattccttttgccgtaatggatgcagtggaataacaatgtttacaggtaccgatcccgatccctgctcaatgtagcatttttttggtttt

SEQ ID NO: 48804 - DNA, 201 bp, Homo sapiens
aaagtcagactgtttttgttgtaaattcactaaaaattagcctacagctttagataagctctctgcatacccacaaattaggcaattgttttagtatatgkttgcactgattatcatttaatagtatattattgaatattatataatatataatattaaatatttatgtacatgaagtaaatcataggagaatttcatatt

SEQ ID NO: 48805 - DNA, 201 bp, Homo sapiens
tctttccctcctgtcctgcaaagtatctgtgatatcccaggctaacctctagattctatccctcctgccctcaatttattcttctaccttttttttttttwaatttccacataagaatcctactaatgcagatcccacatttggaagaaattctcttttgatcttgtgttgccctcagtcactctccttttgtagccaagt

SEQ ID NO: 48806 - DNA, 201 bp, Homo sapiens
ttgagtttaaggagttatttgtatattttggattctagtcctttattagatacatgttttgcaaatattttcttccattttgaggcttgtctttttattcycttgccagtgtgtttgcagagtaaaagtttttaattttaattatgtccaacttagaatttcatctgattgttcacacttttagcattttatttaaaaaaa

SEQ ID NO: 48807 - DNA, 201 bp, Homo sapiens
  misc_feature (1)...(201): n = A,T,C or G, or insertion/deletion polymorphism (see Tables 1-2)
ttggatctaaaaaccaaacatactggagggagaaagccctgcctttagctagcaagtcatcttaaattccagatgctgtagaccgttggtccatttgccangggttcttaatctcttttggaaagtggaactcaaatctgatgaggctgcattccttctctccagaaaaatatacctaaatataattttgtgaattaatag

SEQ ID NO: 48808 - DNA, 201 bp, Homo sapiens
gactgtcatttaaggtattataacaccaagtagaagaaatttgcagctattttaaaaatagctgtctatatctttaaaattctaaaaatttttgttaattytgagatgaacttttttgttataactgattttaggaaaatatatacatgatgtcaaacagctggattaatggaatttttccatttggtatcactgacttct

SEQ ID NO: 48809 - DNA, 201 bp, Homo sapiens
  misc_feature (1)...(201): n = A,T,C or G, or insertion/deletion polymorphism (see Tables 1-2)
gccacagcctgcttatggaatggctgatagtatattcacatatcttttcacataaacagttgacacagaaagtggactcactgtattttttaggaagtctnactctcatttctccttgactttcctttcttatcaagccattcagaggtttgtggcctcaaaataatttctcttcagcagtgagagtagctgttgctgaag

SEQ ID NO: 48810 - DNA, 201 bp, Homo sapiens
  misc_feature (1)...(201): n = A,T,C or G, or insertion/deletion polymorphism (see Tables 1-2)
atttctttaatcagagtttggtagtttttctcatacagattttgcatatattttgttatatttatacccaagtattttaattttggggtgctaatgtaaanggtcttgtgttttaaatttcaaatttcaatcgtcattgctgttatataggaaagcagttgacttttgtgtattaaccttgtctcctgaaactttgctgta

SEQ ID NO: 48811 - DNA, 201 bp, Homo sapiens
agacgatcttaggtcatctagtacagtgtttcttaactttcctgaggtcagaaacccctgtcaggatctaatgaaagcaagggatgtgtcccagaactctscacatatgcataattacacacaatctggggtttgtagaatccctgtagcaggtccataaggacctttcctcatgtgctaatcatgtaaggtatctttgtt

SEQ ID NO: 48812 - DNA, 201 bp, Homo sapiens
caatggaaaggcctctcaaggtaagaaacacttgggtttaagagagggacatgacagggatggtcatttggggatcagaataagcaaagtatcctaagggrcagagcaatcctgtaacacttttgtaagatctggttcagctccatagcaaataatttttccttttcttgcactctatttttagatgtatcagagactgtt

SEQ ID NO: 48813 - DNA, 201 bp, Homo sapiens
tttataactattatgggttttttctttttaaaattagaaatgaatatcagatactttttaagcagctgttgatttgatttttttaaattaaaatttaattwtacatatttaggtacacagtgatgtcttgatacacataatgtatagtgatcagatcagggtaattagctcagagatgatttttttaaatgtaggctattg

SEQ ID NO: 48814 - DNA, 201 bp, Homo sapiens
ttcaaatgccctgaaattagagaggatttcagtgtttatcaagactccaatatttatcaaaactcttacacctgttttttaaaatgctgttaggtatgaayttttaatactttttattgaatatccatcccaggcattatatgaacttctcaagtgtaaccacaatataaaggaagcaatcgaaagatactgctgcaatgg

SEQ ID NO: 48815 - DNA, 201 bp, Homo sapiens
  misc_feature (1)...(201): n = A,T,C or G, or insertion/deletion polymorphism (see Tables 1-2)
tttttcactcttattttgggggatagcctaataagtatgctttcatttaatttttcaaaattattttgtatctgttaacttaatttttaagcttatatcancacagtgaagtaggtacacgtaggcattttacagatgagaaaattgagatacggaaaactataagccctaagattatttctgaatcctagtctagccctc

SEQ ID NO: 48816 - DNA, 201 bp, Homo sapiens
ccaatattgatacattattattaattaaagtccatagtttacattaaggttcgctcttcatgttgtacattccattgattttggcaaatatataatgatayatatccaccagtacagtatcatacagagtagcttcactgacctgaaaatctcatgttttattcttccctctgtcccttccccctcctccctaacaacttc

SEQ ID NO: 48817 - DNA, 201 bp, Homo sapiens
gtagcatggggatcttaattacttccttagaggccccatctccaaatatagccacactgggggttagggcttctacatatgaatttggggagaacataaayattcagtccgtaacacttgtttaccaaagaaataccatgccttttatcatattctttgcaatatacataacattacttgtagccacatgctacattgtat

SEQ ID NO: 48818 - DNA, 201 bp, Homo sapiens
  misc_feature (1)...(201): n = A,T,C or G, or insertion/deletion polymorphism (see Tables 1-2)
aacccatagaatgtacatcatcaagagtaaaccctaatgtaaaccatggtctttgcgtgttgatgtgtcagtgtaggtacattgatttttttaacagatanactactccaatgtaggatgttgaaagtagaacttcaggatatataggaactctctactttctgctcagttctgctgtgaacctcaaactactcttaaaaa

SEQ ID NO: 48819 - DNA, 201 bp, Homo sapiens
  misc_feature (1)...(201): n = A,T,C or G, or insertion/deletion polymorphism (see Tables 1-2)
ccgggcttcgtcccgggtctgtgagtttgtacacttgggactcggggaggaaggcgaggcagccaagagggggcccgaaaggggccgggagcgattcgagngaagctacgtcttgcacttttggcagctgcggaggagcgctcgactccgcctcctctgcgccctgttgccggcgctgcctctttccctggctgtgcgatc

SEQ ID NO: 48820 - DNA, 201 bp, Homo sapiens
  misc_feature (1)...(201): n = A,T,C or G, or insertion/deletion polymorphism (see Tables 1-2)
actaaaacaactagaaacatattctaacaccaccaaatgctggtaaggatgggaagcaacaggaactcttattcattgcctgtaggaatgcaaagtggtanggccacgttggaagatagcttggaagtttcttataataccaaccatactcttaccgtataattaaataatcctgttccttggcatttacccaaatgcgtt

SEQ ID NO: 48821 - DNA, 201 bp, Homo sapiens
  misc_feature (1)...(201): n = A,T,C or G, or insertion/deletion polymorphism (see Tables 1-2)
gggcagccagctggccctctaaggaatcatcactggctcttctcaggtcactttgtgatcaactgtgggcatgttttgcacactctgctttagtgttttcntgttgtttgctttacggattattttattttaaagggaaaactaaaccataagcaaattttaaaaatctcttaattgatggatacagaaatcttaaaaatg

SEQ ID NO: 48822 - DNA, 201 bp, Homo sapiens
atatttctctcataaggttccaactgcttcttaatgatatgttataaaaagatagttttcttaattaatgagatgtaatcatttctaactgtagcactgcyttcttattcttccaggaggaaatagcaaaagacctgttgtcaggtgatgacgaggaaactcagtcttctgcggatgatctgacgccatctgtgacttccc

SEQ ID NO: 48823 - DNA, 201 bp, Homo sapiens
tttcttatttcctttatatttccagagtatagcactccacacaccaatttcaaataaatatgtgttgattatgctttacttatggtctctaattaaagaayttgtggttttgttttttgtcttttttgagacagggtctcactctgtctcccaggctggagggcagtggcatgatcacagcttagtatagccttgatctcg

SEQ ID NO: 48824 - DNA, 201 bp, Homo sapiens
ctctgccccaagtagatacggaattcaccaacattaacatctgctgggaaattgaatgggatttattattttgagagcatggactgtttcttatttccttwatatttccagagtatagcactccacacaccaatttcaaataaatatgtgttgattatgctttacttatggtctctaattaaagaatttgtggttttgttt

SEQ ID NO: 48825 - DNA, 201 bp, Homo sapiens
cttttagacagatgtattaaatgataagcaagtttgactttttctattagaatgtttctttaaaaccatgctgcttaaatcactttgttgttatcataagwtgttttcttgtggactaaaccccttataaaagtgtttgtgaataactttgccttgttattttgctgatttagacatattttcagaatcatggggtcttaa

SEQ ID NO: 48826 - DNA, 201 bp, Homo sapiens
ctttcttttgggatagaggtgaactaatatgccatttaaaaattgaaatatttggccaggtgcagtggctcacacctgtaatcccagcactttgggaggcrgaggcagacagatcacttgaggccaggagtttgagaccagcctagccaacatggtgaaacctgttctttactagaaatacaaaaaattagccaggtgtgg

SEQ ID NO: 48827 - DNA, 201 bp, Homo sapiens
tttggcataccatggaacttgccaagaattcctcaaaaaaagaaaatttgtaatggtggatgtgagctaattaataaatattcttatttcttttttgttgkttttttgttttttgagatggagtcttgctccattgctcaggctggagtgcagtggtgtgatcttggctcactacagcctcgacctcccaggttcaagcga

SEQ ID NO: 48828 - DNA, 201 bp, Homo sapiens
ctctttggcataccatggaacttgccaagaattcctcaaaaaaagaaaatttgtaatggtggatgtgagctaattaataaatattcttatttcttttttgktgtttttttgttttttgagatggagtcttgctccattgctcaggctggagtgcagtggtgtgatcttggctcactacagcctcgacctcccaggttcaag

SEQ ID NO: 48829 - DNA, 201 bp, Homo sapiens
aaataatatgcatttaataggtactcaataaatacttataacatggaattatattgtatttatgtttagttcgtgcaaattaaatgaaaaacaaagaaaakggcatactttttgctattcctgaaatatttcataataataatttttttaaaaaatgaaactttaaaaaatgccttaggaaagtgccacattgaaagtgaa

SEQ ID NO: 48830 - DNA, 201 bp, Homo sapiens
catggaattatattgtatttatgtttagttcgtgcaaattaaatgaaaaacaaagaaaatggcatactttttgctattcctgaaatatttcataataatawtttttttaaaaaatgaaactttaaaaaatgccttaggaaagtgccacattgaaagtgaatatacagcctcccaaaaagtccgatgcagccaattttcctt

SEQ ID NO: 48831 - DNA, 201 bp, Homo sapiens
ttgggggaaggagtgaagggcctaagccttaggggctgcttgggggaagtgtcagttaagctcatggggtgagtctagagtttgactcacaaaaggggctygataactgtctgaatggcttttctccaggacaggggaaagtatcttgtcgctgctgagggatccctccaaaaggaaggttccaccccagccccttacacc

SEQ ID NO: 48832 - DNA, 201 bp, Homo sapiens
ttcctgctggagaaccccagcggctacctgtcccgctcctttgaccttggccgccagtttctgttccactggacagtgaactggcgcttcctcccagaggygctcttcctgcatcgagccttccacctggccctgttgactgcccacctcaccctgctcctgctgtttgccctctgcaggtggcacaggtgagaaaaggca

SEQ ID NO: 48833 - DNA, 201 bp, Homo sapiens
ggtgagtctagagtttgactcacaaaaggggcttgataactgtctgaatggcttttctccaggacaggggaaagtatcttgtcgctgctgagggatccctscaaaaggaaggttccaccccagccccttacacccaaccatatcctttaaattgtgggaaggtaagtcttgccctctctaggtgctgacagagtcctggtc

SEQ ID NO: 48834 - DNA, 201 bp, Homo sapiens
gtggggaacgtggttttcctgctatttctagtgggaattggggaacctctgaggcctacatccccgtcccacacccctcaatgagtagcatgaaggctggycattgggaatgagccttggcagctctgctgacatcacaccaatcctcaggtggtgctggggctgcccttcctgctggagaaccccagcggctacctgtcc

SEQ ID NO: 48835 - DNA, 201 bp, Homo sapiens
gggggaagtgtcagttaagctcatggggtgagtctagagtttgactcacaaaaggggcttgataactgtctgaatggcttttctccaggacaggggaaagyatcttgtcgctgctgagggatccctccaaaaggaaggttccaccccagccccttacacccaaccatatcctttaaattgtgggaaggtaagtcttgccct

SEQ ID NO: 48836 - DNA, 201 bp, Homo sapiens
tccactccatctttgtgctgcggctcttcaatgacccagtggccatggtgctgctcttcctcagtatcaacctcctgctggcccagcgctggggctggggytgctgctttttcaggtcaacacctcttcctttctggtcccctctcgttttctgcatttccatctcttcccaatttcctgcagcagagggagtaaaggagt

SEQ ID NO: 48837 - DNA, 201 bp, Homo sapiens
tcagggaggatgtgaggggctggttaggtactagtctgtgtgacctgacccaggctcacattttctctcatcttccaggtacccagctggtttcgtgtacrtctttatggggttgtactatgccaccagccgaggcactgacatccgcatggcccagaacatctttgctgtgctctacctggctaccttgctgcttgtctt

SEQ ID NO: 48838 - DNA, 201 bp, Homo sapiens
  misc_feature (1)...(201): n = A,T,C or G, or insertion/deletion polymorphism (see Tables 1-2)
caggtatcccttgacagctggtgacctgggcgaggaaaggggaccccaatcatagaagtcctattctgcaccactgtgctgagcacttcacatattgaagnatatttgattcttaattctaaatacgagctactcttatgagtacttctccctggtactatcataagagatttacatatgttctaatattgaaagctcaca

SEQ ID NO: 48839 - DNA, 201 bp, Homo sapiens
atctgcctcctgcctactccaggctcttccctccaacagttgtgagtgtaggtcccatcttggagtttgttggcgtggcggcgggggggaggttgctgtgrtgatggtggggggtatgtctttgggtgttgtgtgcatggccctggagctgatctccacccttcctctcccctgctcaccccagcctggcagtctctgtga

SEQ ID NO: 48840 - DNA, 201 bp, Homo sapiens
  misc_feature (1)...(201): n = A,T,C or G, or insertion/deletion polymorphism (see Tables 1-2)
ggcccgcagcctttccccaagagcacccaacacagcaagaaagcccactgaagtccacccctttccctcaggacctgagtctaccctcaggacctggggtnggttggactctgcccttccaaataaaccttgctaagtccaactctgtgcaacctacatggaggtgggggcagccgatgcctggtccaggctgtgagggac

SEQ ID NO: 48841 - DNA, 201 bp, Homo sapiens
cgaggaagagtgggacacggggtgcctgatggcatccctgatgtggtggtggagatggccgaggcagacctgcgggccctgctatgcagagagctgcggcscctgggggcctacatgagtggacggctgaaggtgaagggcgacctggctatggccatgaagctggaggctgtcctcagggccttgaagtagcagccttgg

SEQ ID NO: 48842 - DNA, 201 bp, Homo sapiens
gcagtccaggcccgtgctggcgggattgggcatgggaaggagcagggcctgctgcttccctggcgctgctcccaaagatttctgactcatctgccagctcygtcctgcatgcctggcgagctggggcccagggcagcatgaaggagagccctgcgttctgtgcttcttaccagaggtttgcaagcctcagacaaataaatg

SEQ ID NO: 48843 - DNA, 201 bp, Homo sapiens
tttgttgaattaattacatttctcctcacactgtcctccagctggagatcaacgatgtgaccagggcctgggggctggaggtagaccgcgtggagctggcrgtggaggccgtgctccagccgccccaggacagcccagctgggcccaacctggacagcaccctccagcagctggccctgcacttcctgggaggaagcatga

SEQ ID NO: 48844 - DNA, 201 bp, Homo sapiens
agtcctcagccgacatgtgagggtccagctaaatggaactctggttcctcgcagctccacgaacatgccaggttttcttgtctggggttttgcacatgctrttcctgttgctggaagggtcctcctccacctgaggactccctcctgctggcaccaccctcctctgctgggggctcaccacaggccttgcttctgtcttgg

SEQ ID NO: 48845 - DNA, 201 bp, Homo sapiens
tgggccttcatttctcaatttggacatcactacttctctaggaggtccagggacctaaagttgacaaagccctttccccgggggtgctgttagggcagccsagccttttctcctaactaatccaaggacagacagtttcctggtatgagtcatgtctaacttcagaccacagagatgaaaagtttctctaaggatcaagtc

SEQ ID NO: 48846 - DNA, 201 bp, Homo sapiens
aagggatacgatgtggagagggggctggacccggcgcctggtgctagcgccgatccgccctccctagggtcatggggctttggccccagagccagccagcsttgctcctatcttccaaaacctcacctcaccacatttgtcctcggctcttatcagccctttaggcctgggaagacgtttcaggtttctatttcgcataga

SEQ ID NO: 48847 - DNA, 201 bp, Homo sapiens
aactaatccaaggacagacagtttcctggtatgagtcatgtctaacttcagaccacagagatgaaaagtttctctaaggatcaagtcaatacagtgcagtrgttaagacacatggcctttggagttattcagaactgcattcaaatcttcactatttcacttagggctatgcaatttttgagcagtcacttagcttccctg

SEQ ID NO: 48848 - DNA, 201 bp, Homo sapiens
cttgccattgtggacagattgtgcccacctacgagcggatgattgtgttccgcctgggccggatccgcaccccccagggacctggcatggttctgctcttrcccttcattgactcctttcagagggtggatctgaggacacgagccttcaacgtccctccctgcaaggtgaggggcttctcagctgccttgacagaggaac

SEQ ID NO: 48849 - DNA, 201 bp, Homo sapiens
gaagctcaagatcagcgaccagcttctggtaggcagcccctcacaagacggagcttgaggggtggcaccggcctggctccacctgccaggtcactttgagmaaagagtcagaccactctgggcctcagtttaccatatgtcccaatagtgtaaccacctttgaagagccagtgcctgggtggggccatgagttgaggaatg

SEQ ID NO: 48850 - DNA, 201 bp, Homo sapiens
acagcccagctgggcccaacctggacagcaccctccagcagctggccctgcacttcctgggaggaagcatgaactcaatggcaggaggtgccccgtccccrgggccaggtgaggagccctggggaggagagcgggggtgtttaccagcttggtgccagcacagactttgctcactatcccagcagctctgtgcagtacaca

SEQ ID NO: 48851 - DNA, 201 bp, Homo sapiens
aacagaccctaacttgcagctgcccaaagatacgggaatattaggcaaggagccagattgagagccctgagaaggaaggagcctctcgaggggaaggtggrcgtaaggtacacttgcccaagttcactccgcttggcagctgtcgtggcaggtccagttgaccacctctgctctcacctgcagatgtaccccagagctggc

SEQ ID NO: 48852 - DNA, 201 bp, Homo sapiens
ctggcggaggggctactgactgctctacagcccttcctgtctgaggccctggtcagccaagtcggggcctgctaccagttcaatgtcgtcctgcccagcgscacccaaagcgcctacttcctggacctcactacaggtgccgctgccctccttgcctctccttcccatccagcttgctaggtttcttgttacctaccccag

SEQ ID NO: 48853 - DNA, 201 bp, Homo sapiens
gcagaggccagctgtgctgccctggtgaaggctggcaaagtctatgctgcggctaccgaggacatggactgcctcaccttcggcagccctgtgctaatgcracacctgactgccagtgaagccaaaaagctgccaatccaggaattccacctgagccggattctgcaggagctgggcctgaaccaggaacagtttgtggat

SEQ ID NO: 48854 - DNA, 201 bp, Homo sapiens
ttcggcagccctgtgctaatgcgacacctgactgccagtgaagccaaaaagctgccaatccaggaattccacctgagccggattctgcaggagctgggccwgaaccaggaacagtttgtggatctgtgcatcctgctaggcagtgactactgtgagagtatccggggtattgggcccaagcgggctgtggacctcatccag

SEQ ID NO: 48855 - DNA, 201 bp, Homo sapiens
tcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaata

SEQ ID NO: 48856 - DNA, 201 bp, Homo sapiens
gggtcaagaggctgagtaagagccgccaaggcagcacccagggccgcctggatgatttcttcaaggtgaccggctcactctcttcagctaagcgcaaggakccagaacccaagggatccactaagaagaaggcaaagactggggcagcagggaagtttaaaaggggaaaataaatgtgtttccccattatacctccttcac

SEQ ID NO: 48857 - DNA, 201 bp, Homo sapiens
agctaattttttttttttttgtatttttagtagagacagggtttcaccgtgttggccaggatggcaagatgattttaaattgcaccccctaaaaatccttyttaatagttatacatttaatacatattaaaatataactaatagaacacaaatattattgcttatgagttttccagtttagttttttaaaaaaaattctaa

SEQ ID NO: 48858 - DNA, 201 bp, Homo sapiens
accacttctcaggcagtttaatggacactaagtccattgttacatgaaagtgatagatagcaacaagttttggagaagagagagggagataaaagggggakacaaaagatgtacagaaatgatttcctggctggccaactggtggccagtgggaggtgatggtggacctagactgtgcttttctgtcttgttcagccttga

SEQ ID NO: 48859 - DNA, 201 bp, Homo sapiens
tttaaaaggggaaaataaatgtgtttccccattatacctccttcaccccagaatatttgccgtcttgtacccttaagagctacagctagagaaaccttcabggggtggagagaggattctaaggcttttctagcgtgacccttttcagtagtgctagtcccttttttacttgatcttaatggcaagaaggccacagaggta

SEQ ID NO: 48860 - DNA, 201 bp, Homo sapiens
cagaacccaagggatccactaagaagaaggcaaagactggggcagcagggaagtttaaaaggggaaaataaatgtgtttccccattatacctccttcaccscagaatatttgccgtcttgtacccttaagagctacagctagagaaaccttcacggggtggagagaggattctaaggcttttctagcgtgacccttttcag

SEQ ID NO: 48861 - DNA, 201 bp, Homo sapiens
cgaggacatggactgcctcaccttcggcagccctgtgctaatgcgacacctgactgccagtgaagccaaaaagctgccaatccaggaattccacctgagcyggattctgcaggagctgggcctgaaccaggaacagtttgtggatctgtgcatcctgctaggcagtgactactgtgagagtatccggggtattgggcccaa

SEQ ID NO: 48862 - DNA, 201 bp, Homo sapiens
gagggcacagctaaggaaaagtgggaaaaggcgggccttattccagctttctgttgagatcccagaatgtagggttaggttgggaaccagaacatgaaagrtcgtgatgccatgctgaagtgtttggactgaattagaaggaagaattgaacagtcattgatgctctagaaagaaccctgtgaagaaagagtgggaacaat

SEQ ID NO: 48863 - DNA, 201 bp, Homo sapiens
  misc_feature (1)...(201): n = A,T,C or G, or insertion/deletion polymorphism (see Tables 1-2)
ttcgggtgtagagggagcaggggcctgcggggacctggtgtgggtggagtggggacaagcggtggagaagggtacgccagggtcgctgagagactctgttntccctggagggactggttgccatgagagcagccgtctgaggggacgcagcctgcactacgcgccccaagaggctgtgcgtggcgagcaggtcacgtgacg

SEQ ID NO: 48864 - DNA, 201 bp, Homo sapiens
gtgtcctttttgttgtgtggaatttagttgaaggcatgaagttggtgagataacaccagttataacctttctcctttcctccgtctctgacttgcctttcytttttagtcatccctcctctgtgttgccatgggaattcaaggcctggccaaactaattgctgatgtggcccccagtgccatccgggagaatgacatcaag

SEQ ID NO: 48865 - DNA, 201 bp, Homo sapiens
gtctagttattcagaggagtaagatggtgatgttcacctggcaatcagctgagttgagactttggaataagacactggttttcatgcgctgtttttgtttraaagttatgaagaaaaaagtcaataaaattctaaaagtaaccaaaatgtcatgttctttgagaacatttgaaaatatcccaagtgaccatggctccaaat

SEQ ID NO: 48866 - DNA, 201 bp, Homo sapiens
tcctgagtgcctctgctacgagttactgttcacctctctgtgctcttaagttcttgaatcactagactcccctttgtattgggcagaggaagaaacatcasgaccctccagaaaacaccaaggcaagggtgaagtatggcaaggaagagcaaggcaaagtccttctgatgactcccgtgttcaaatgtgagattgtcaata

SEQ ID NO: 48867 - DNA, 201 bp, Homo sapiens
atcttaaactgtggacacctgggagcaccctcaaaaggcagctgggcctagggagatggcctgtgcttctgtgtcaggagttggttccttcaggtgggctygtggtctcgctgacgtcaagaatgaagccatgaaccttcgcggtgagtgttacagctcttacaggtggcgtggacccaaagagtgagcagcagcaagatt

SEQ ID NO: 48868 - DNA, 201 bp, Homo sapiens
caaagacatggaaggttagaggtttgtcaacaaaaagacatggaaggttaggtttgtcaacacaaagacatggaagattagaggtttgtcaacacaaagayacaggaagaatgggctgcagaagatttagatgttttccatttgggcacattttacttagctggagaactaggtttaaaacagcctgggtaggaaaattag

SEQ ID NO: 48869 - DNA, 201 bp, Homo sapiens
gcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctga

SEQ ID NO: 48870 - DNA, 201 bp, Homo sapiens
cggactgcagtggcgcaatctcggctcactgcaagctctccgcttcccgggttcacgccattctcctgcctcagcctcccgagtagctgggattacaggcrcccgccaccgcgcccggctaattttttgtatttttagtagagacggggtttcaccttgttagccaggatggtctcgatctcctgacctcatgatccaccc

SEQ ID NO: 48871 - DNA, 201 bp, Homo sapiens
  misc_feature (1)...(201): n = A,T,C or G, or insertion/deletion polymorphism (see Tables 1-2)
gcaaagagaccttgtaggccttggtacttttgaaggggacatgcaagaagggctggggggtgccaatgggaatggaagaaaggagcagtggcactagatantgcaggattggacccctgagaagctgaagatgagtgagtctggataaccaggagaatggctgcaccatgcaaacaaagagctgctgagaggaagaggaag

SEQ ID NO: 48872 - DNA, 201 bp, Homo sapiens
ggggacatgcaagaagggctggggggtgccaatgggaatggaagaaaggagcagtggcactagatactgcaggattggacccctgagaagctgaagatgastgagtctggataaccaggagaatggctgcaccatgcaaacaaagagctgctgagaggaagaggaagagttgttcgtgactgttatgctcgctgcttttct

SEQ ID NO: 48873 - DNA, 201 bp, Homo sapiens; identical to SEQ ID NO: 38532

SEQ ID NO: 48874 - DNA, 201 bp, Homo sapiens
  misc_feature (1)...(201): n = A,T,C or G, or insertion/deletion polymorphism (see Tables 1-2)
cccatttggcaagccttctgctcatgtttcagtcctttctgtattctagatgtcagtccatcataagtcatgagcttcaggccaggtgtggtgactcatgnctgtaatcctagcactttgggaggccaaggtggccggatcacttgatctcagttcaagaccagcctggccaacgtggtgaaacctctactaaaaatacaa

SEQ ID NO: 48875 - DNA, 201 bp, Homo sapiens
ggagcagcctttttttttttttttttttttgagacggagtctccctgtcgcccaggctggagtgcagtggcgcgatctcggctcactgcaggctccgcccycccccggggttcacgccattctcctgcctcagcctcccgagtagctgggactacaggcgcccgctacctcgcccggctaattttttgtatttttagtaga

SEQ ID NO: 48876 - DNA, 201 bp, Homo sapiens
  misc_feature (1)...(201): n = A,T,C or G, or insertion/deletion polymorphism (see Tables 1-2)
agctttgagcccaccaagaatgtaagaccctgtgtttgctatgtcgcaactattggttgttgagggggacagagagggggtggaaggagagtctagatggnatcacagtcatagtaatcacagtcagtagtagctctggggagtcttgaggtccctgcttctcttgcatagtcatgaggtcacaggcccaagggagcatgg

SEQ ID NO: 48877 - DNA, 201 bp, Homo sapiens
tgaagagcaaagaacaaagcttccacagcgtggaagggtacccgagcaggttgccgctgctggacgttggggggtgtgagggggagcagcctttttttttytttttttttttgagacggagtctccctgtcgcccaggctggagtgcagtggcgcgatctcggctcactgcaggctccgccctcccccggggttcacgcca

SEQ ID NO: 48878 - DNA, 201 bp, Homo sapiens
tactccagcctgggcgacagagcaagactccatttcaaaaaaaaaaaaaaaatccactcatataaaaggtgagctcagctcactggtccatttctcagtgscttctccatcctcatttgcaaacctcagagggataaggcagttgaacctgatgagcaagaattataacagcaaggaaacattaatgcttagaattctgag

SEQ ID NO: 48879 - DNA, 201 bp, Homo sapiens
  misc_feature (1)...(201): n = A,T,C or G, or insertion/deletion polymorphism (see Tables 1-2)
agtgcctgccctccaagcagggcagatctgaaggtatgcaggagtgagtgcaggaacatgcattctgctgtcttgacctgtctgctctttagccacatggncatcttcatttctctcactgcctttttagctgcttctccaagggttctcttcttcctatgcggtttgttctctgccacagcccacctgtgccaggagcca

SEQ ID NO: 48880 - DNA, 201 bp, Homo sapiens
gggcgacagagcaagactccatttcaaaaaaaaaaaaaaaatccactcatataaaaggtgagctcagctcactggtccatttctcagtggcttctccatcmtcatttgcaaacctcagagggataaggcagttgaacctgatgagcaagaattataacagcaaggaaacattaatgcttagaattctgagatccagcacaa

SEQ ID NO: 48881 - DNA, 201 bp, Homo sapiens
ctgggtaggaaaattagaagcaagctggatgcagtggctcatgcctgtaatcccaacacttttgggaggtccaggcaggaggatcacttgggcccaggagktcaagcctgcagcgagctgagatcacaccactgcactccagcctggggtgatagaacaagaccctgtctcaaaaaaaaaaaaaacaacaaaaacttagaa

SEQ ID NO: 48882 - DNA, 201 bp, Homo sapiens
  misc_feature (1)...(201): n = A,T,C or G, or insertion/deletion polymorphism (see Tables 1-2)
cccttgtggttgtctggttacctgaactaattggagtgcgatgcagacatagtcatggagtgagacagcagaactttgctgtcttgtttgtgagcccacancaggggttctagactggctggttgacatggtggccccagcctgtctcttcagcagctcggcttataaaaaataaccaccacctactggggaaaactgctg

SEQ ID NO: 48883 - DNA, 201 bp, Homo sapiens
  misc_feature (1)...(201): n = A,T,C or G, or insertion/deletion polymorphism (see Tables 1-2)
gatttgatcagggcactggcatggactgagccatggtcctggcagattcatttggcggcatgctgaaggatttagattggctaggaagagctagaggcaangagaccttgtaggccttggtacttttgaaggggacatgcaagaagggctggggggtgccaatgggaatggaagaaaggagcagtggcactagatactgca

SEQ ID NO: 48884 - DNA, 201 bp, Homo sapiens
  misc_feature (1)...(201): n = A,T,C or G, or insertion/deletion polymorphism (see Tables 1-2)
gagccctgactgcggccaagggcgcaggcgtgtcccggcgcatgcgcagacgaaacaggcaccaacgctggagcttcccgcagtgtgatttggggccgggnatgccgcggcggggacggcgattggtccgtatgtgtggtgccaccggccgccggctccgccccggcccccgccccacacgccgcatcacttacagggccc

SEQ ID NO: 48885 - DNA, 201 bp, Homo sapiens
acacacccaggggaaaggccagcccaggcaggtgtttcttagtggttcccctcagccaatgcttcccattccttgatgcatccttctaactagagcagatrctcggtgatcttaaactgtggacacctgggagcaccctcaaaaggcagctgggcctagggagatggcctgtgcttctgtgtcaggagttggttccttcag

SEQ ID NO: 48886 - DNA, 201 bp, Homo sapiens
  misc_feature (1)...(201): n = A,T,C or G, or insertion/deletion polymorphism (see Tables 1-2)
tcccatgcacattgatcatgaccggaacatggactgggtttccacccaggtaagggacagtcactcagaagactggagcataacacaactattgaaaaggntgcgtaggtgaaaacagcaaaaacaaaaagtcccccaaacagcattttctcattagcctgaggctcttgttctgcaaccatgtgaagggagtgaccaaga

SEQ ID NO: 48887 - DNA, 201 bp, Homo sapiens
  misc_feature (1)...(201): n = A,T,C or G, or insertion/deletion polymorphism (see Tables 1-2)
ggcttataaaaaataaccaccacctactggggaaaactgctggaaccttcagattgccaaattgttcttggtgtcttttccagaaatatttgccaaactcnaattagccttcaggagatttgataaagctcatgtttaagtcaagagaccaaaagattttgatggggagaattaggggctggatatagagggaatacttaa

SEQ ID NO: 48888 - DNA, 201 bp, Homo sapiens
  misc_feature (1)...(201): n = A,T,C or G, or insertion/deletion polymorphism (see Tables 1-2)
ctaaaggagtcagggcagctctggctagatgcctatcttcaccaataacaacagccaccctgcccagtctggaagaagaggaggaagactctggagccaangcagaggggagcttgagggacaatgccactatagtttaatactcagagggggttgggtttggggacataaagcctctgactcaaactcctcccttttatc

SEQ ID NO: 48889 - DNA, 201 bp, Homo sapiens
caaaagacttcatttgtaacccatgatgttcatctgtgtgtgcacaggattcctgagtgcctctgctacgagttactgttcacctctctgtgctcttaagwtcttgaatcactagactcccctttgtattgggcagaggaagaaacatcaggaccctccagaaaacaccaaggcaagggtgaagtatggcaaggaagagca

SEQ ID NO: 48890 - DNA, 201 bp, Homo sapiens
  misc_feature (1)...(201): n = A,T,C or G, or insertion/deletion polymorphism (see Tables 1-2)
tggtagagagagttgctggctatttaaaaagctctttcatcttttaattcacctcttcttttcacctctttaaccactcctcaggaacagaacacttctangactgggggtcttttagctccataagcaagtgagcagatgggacaagttagtcttttctccctagaaacaaaggggatgcccagtggtttccctttgctt

SEQ ID NO: 48891 - DNA, 201 bp, Homo sapiens
catattgtggaggactagtgtcaggggaagagtatggtgcttggttcagtgatgagagatttgatcagggcactggcatggactgagccatggtcctggcygattcatttggcggcatgctgaaggatttagattggctaggaagagctagaggcaaagagaccttgtaggccttggtacttttgaaggggacatgcaaga

SEQ ID NO: 48892 - DNA, 201 bp, Homo sapiens
  misc_feature (1)...(201): n = A,T,C or G, or insertion/deletion polymorphism (see Tables 1-2)
gactgggggtcttttagctccataagcaagtgagcagatgggacaagttagtcttttctccctagaaacaaaggggatgcccagtggtttccctttgcttnccaacctaaaatttcaagtttaataaaatagcaattagcagaagtgaccaaattgggagataattatcagtcatgaggaaagacacagatttcggtcata

SEQ ID NO: 48893 - DNA, 201 bp, Homo sapiens
ttgttactttcacttttttacaacctggccagaggcattttttaaatcaggcccaatatcagtattctttttgtgtgtgccaattttgttatcacatcccyatgaagttgaaaaataaagttaattttgaccaaaagacttcatttgtaacccatgatgttcatctgtgtgtgcacaggattcctgagtgcctctgctacg

SEQ ID NO: 48894 - DNA, 201 bp, Homo sapiens
ttcaccttgttagccaggatggtctcgatctcctgacctcatgatccacccgcctcggcctcccaaagtgctgggattacaggcgtgagccaccgcgcccygcccctcaaccttatcttaaactttgtcaagatgggccaaggtaacctggtagagcccagtccaacccccagaggaacaaaggtacagatagttctggaa

SEQ ID NO: 48895 - DNA, 201 bp, Homo sapiens
aggtcagagaatttctttctttttttttttttgagatggagtctcactctgtcacccaggctggagtgcaatggcacgatctcggctcatggcacctctgyctcccgggttcaacagattctcctgcctcagcctcccaagcagctgggattacaggcgcgtgccaccatgcccagctaattttttatgtttttgatagag

SEQ ID NO: 48896 - DNA, 201 bp, Homo sapiens
  misc_feature (1)...(201): n = A,T,C or G, or insertion/deletion polymorphism (see Tables 1-2)
aggcactgagcaggcctcgcaggctgtggaggccatgtcggggcggagtgcccaaagcaagcggggccatctggagaggaggaaatgcctgggcatggggngcactcagtggctgagcaggtggaaagacaggagctgggagtgggcgtgcccggccggcagggacagagtcagacaaggtggagggtatgggtgctggtg

SEQ ID NO: 48897 - DNA, 201 bp, Homo sapiens
aggagaccactcctccctgaggcagacagcaaagtgccttccacggaagccaccgggaagcctcgagtggctcctgcccaccagcgtcccctggtgagccytagagtgagtaatcaagtgtaagaaagcccccgaggttccctggtgggcggggagcacccccttgggtctctctggggcggtctgaggggtctgggctgc

SEQ ID NO: 48898 - DNA, 201 bp, Homo sapiens
tggtggagagctttatagctaatggttgggagttttaattttatttaaagggcatttaggagtcataataggctcttgagaagggaatttatttatgtatktatttatttatttatttattttattgttttgagactgagtcttgctctattgcccaggctggagtgcagtgacgcagtctcggctcattgcaacctctgc

SEQ ID NO: 48899 - DNA, 201 bp, Homo sapiens
gacccttccagtgatgtgtttctggggagcagcatgtttggggtgtcgagaaagaaggatgtggcagtgtaagaaggtgctggagagcctctccagccagaaggatttgtcagctgagggtgggctctgtgctggagtctgtctgcaccaggatcgctttctgctcaggtgataagggaatgcgtggattcagagagggcg

SEQ ID NO: 48900 - DNA, 201 bp, Homo sapiens
  misc_feature (1)...(201): n = A,T,C or G, or insertion/deletion polymorphism (see Tables 1-2)
gtactacacctcctgcaacgacctcactgccaagaatgtcaccctcggtacgtctgggtgaggcctgctggagcctcagcagccccgggggcacaggggangagatcagtttagagaggaagaagcttgggcattgccagagggcagtgccttctgtgggggcaccagcaggttggctgggcgagactgcttccctcaccc

SEQ ID NO: 48901 - DNA, 201 bp, Homo sapiens
cctagccctgccctggatgagccccagggccctcccatccggggtgctggccctgctcccctgactggtcctcctggcccacacatcactgactcagaggyagccctgtcaccggagaagcgaggagccactcgttattaagaacctattataggccagaccatttctgcatcttggacccttgatctcacaccagccttg

SEQ ID NO: 48902 - DNA, 201 bp, Homo sapiens
aggagtaggcacgaccccggcaggctagcccgccagcccgccaggccacagctcgccaagtggctgcaccggggatagggaggcgggccgggcggacatgygggctggccacctggccccacgccctctcgcccaccctgggggctatgcccactggccaagggagacttggctgcttcctccccgaatgatgccgggctc

SEQ ID NO: 48903 - DNA, 201 bp, Homo sapiens
gggtcttgctgctggggtgcagaactggcaccacacctgcagcccagagcagctggctcaagcacctggggagcaggctgtctggacccccgctgcccggmaggaattctcaccgtcccaccctcctgcactgctgtgttcggctccccgtggaccttccacgtcagctcagcactgcagccagagccacacccgtgcctg

SEQ ID NO: 48904 - DNA, 201 bp, Homo sapiens
agttgttgtcatcattgtccactgctgataataacaatggtaataacagtgaagccaagcattgcgtgtagtaagttacaagtccaccacacagctgtcawcttccccataatatgggtggagaaactgaggtacagagagatgatgggacttgcctgaggttacacagctagaaaatggtaaggctgggaactagcccag

SEQ ID NO: 48905 - DNA, 201 bp, Homo sapiens
tggtgacaggacgggcttggggcctgggaggcggggggtggggggtctgctaatggcccgctgcctctgcctttgctactgagctggctgaaagcccagcrataggaaaggccaggccggggttctaggcccttccctggcatgcaagtggcagccatccttcagccaggcctgctctccttgcagccatcctggtgatcg

SEQ ID NO: 48906 - DNA, 201 bp, Homo sapiens
gaagtgaacacgctctcatctaatttttgcacagtcctatgacataaatgttgtcactcccattttacagatgaggaaatggaggctcagagagattaggwaacttgcctaagatgtgtctgattccacagttcagacatgattctgagatcctgatagaatgaggaaatgggccaggcgcggtggctcatgcctgtaatc

SEQ ID NO: 48907 - DNA, 201 bp, Homo sapiens
gcccggaggaggtgcctgaaacatctagccccttagggcaatgacacccctgctaccattgctggacctgaccccaacactggggggagttgctgctactrtctccccatggctgaccctgagtcttttactggccgcccatgcccttctaggcattcgatgccaggtggacaatggtcttatggaggaggtgcctgctgc

SEQ ID NO: 48908 - DNA, 201 bp, Homo sapiens
  misc_feature (1)...(201): n = A,T,C or G, or insertion/deletion polymorphism (see Tables 1-2)
agcaccaggcccactgagcctctgcagagccaccagccatgcccgggatcgtggtgttccggcggcgctggtctgtgggcagtgatgacctcgtcctaccngccatcttcctctttctcctgcataccacctggtgagtccccaggcccggggccacaggcctgggtttggagagaaaggtctggaaggacgctttctggc

SEQ ID NO: 48909 - DNA, 201 bp, Homo sapiens
gagcctggcttttgtccccagaagcatttggggttagggaggctccaatgtccctttcttcagagcgggtgagccagagaggtgtccccagcgcccctacmtaatgcctcccactgctgcccgcaggaatggttgtctgcaactgggtagtcatcctcagtgtgtgcatcactgtcctctgcgtcttcgaccccacgggcc

SEQ ID NO: 48910 - DNA, 201 bp, Homo sapiens
  misc_feature (1)...(201): n = A,T,C or G, or insertion/deletion polymorphism (see Tables 1-2)
aggtatgccgtgcctgccctggaagccccactggtgtgggataggaagggcaggcagcgcctacccccgccccactgtggctgttagaggggaggaccctntgccccaggggaggagagccagaagaggtgctttgtggcagccccagaccaggaagtagcctctgccctccccgctcctgagacatttcctccagatgaa

SEQ ID NO: 48911 - DNA, 201 bp, Homo sapiens
aggaacttaaggaatttttcttaagggttgtttcagtttcatacctttgaaaagaacttgcttctcctttgacaccttcgctgggactggggccagaccgkggagcagataatagttttgccacgtgtagtctcccatctccccatttattcaaggacatttattgagcacctacttgccaagccttgtgcctggagctgg

SEQ ID NO: 48912 - DNA, 201 bp, Homo sapiens
aattcgccgagttcatcgacagcctcttcaacctggacagcaagagcagctccttccaagacctctactgcatggtggtgcccgagagccccaccagtgastacgctgagggccccaagtcccccagccagcaagagatcctgctccgtgcccagttcgagcccaacctggtgcccaagcccccacggctctttgccggct

SEQ ID NO: 48913 - DNA, 201 bp, Homo sapiens
aggagcactcgccgggctgtggggcgagtcgtgaccagatgggcaagtctcaggccttggggagtggtgacctcaggaggaggagagtgggacccaagtgrctccatgaggctttgcttggcctgagaggcctgggccctggctccacatcggccccacgatggggcctgatgtccctccaccacccccagcctcctctgt

SEQ ID NO: 48914 - DNA, 201 bp, Homo sapiens
cctcgaagacagctgtgagcaaggtgggggctgcgccaggagagagaataggagcaggcaagtgggtagacctttcccactgtgctccttcagacggctgygccctggctcctccctccagggtcggcttcctcccctgacacagctggtgagctgggccgtgcagcaggtggagcaggtgtggcccaggccaaaagcagg

SEQ ID NO: 48915 - DNA, 201 bp, Homo sapiens
tccctccccaggattggcctctctcagctggaaggcttccgcagacagctcctggatgtcctgcagcgaagcaccaagcccaaagtgagcccccacctggkcaccctgcctctgtgcagcctcatctgtccctgcccttgacccccaccggtttcttgggacaaagcacaagaggccctgccatggaaggccagggcaggg

SEQ ID NO: 48916 - DNA, 201 bp, Homo sapiens
agcagggcttgcttgtggctgggccccccgattccggaacaccaccaccccgcccccttggccttagcttctgcttcggcttcccttgcagtgaggatgcyatggagtattccaaggagttcgtgactgctgtggttctgggcaaagacctcgtccccaggtgagtccttggccccgctccatggtcccttgccaggctgt

SEQ ID NO: 48917 - DNA, 201 bp, Homo sapiens
  misc_feature (1)...(201): n = A,T,C or G, or insertion/deletion polymorphism (see Tables 1-2)
aaaaaaagaaaataaggttttattggcacatatccattcagtaaggtattgtctccagctgctttgcccctacagcagccgagttgagtagttactacagngactgtaggactcccagagtccaagatatttgctctctggccctttacaggaaaaggtgctgaccccatcctcaaccatgtgcatctcttcaaagcatat

SEQ ID NO: 48918 - DNA, 201 bp, Homo sapiens
gccacaaggtaacccacgtcatggaccccagggcccctgggcttctttcctgccctgccagtgtgcagaggcgtgtatggttgggggttcctccctgctcrctgggctcactggaagagattggtcagagaggcatgaattagtctggaaggcccgttgcggcccactgctgcgaccccactgccctgcacagcccagagc

SEQ ID NO: 48919 - DNA, 201 bp, Homo sapiens
ctccaccccagcagccaataacctcctcagcatcaacagtggctgctgggcctcagacacactggctttcaaactggtgcctttctcccaagagatcccaytctcccaccaacgcagcccctgcccggagccctgggagcctgcagctggctgagtcaagttgaaggctcccaatatttgcagtcaaagaacccaagggcc

SEQ ID NO: 48920 - DNA, 201 bp, Homo sapiens
gcttcattagccacactgcccctctgagcctcagttcccacctgtgaaatggaagtgacaggatcagcgtgtctgccagcccccacagctgggttgtcacraggcccaaagggaaaaatggatggggcagggttcctgagctgcaggtcactgtgggtttgctggtcactgggaggcctcccaccaacacctgcttctgtt

SEQ ID NO: 48921 - DNA, 201 bp, Homo sapiens
  misc_feature (1)...(201): n = A,T,C or G, or insertion/deletion polymorphism (see Tables 1-2)
ctgtaatcccagctacttgggaggctgacgcaggagaatcacttgaacccaggaggcagaggttgcagtgagccgagattgcgccactgcactccagcctnggtgacagagcaagtctccatctcaaaaaaaaagaaaataaggttttattggcacatatccattcagtaaggtattgtctccagctgctttgcccctaca

SEQ ID NO: 48922 - DNA, 201 bp, Homo sapiens
ggaccacttgaggtcaggagttcaagaccagcctggccaacatgacgaaaccccgtctctactaaaaatacaaaaattagctgggcctggtggtgggtgcrtgtaatcccatctaccctagggactgaagcaggagaatctcttgaacccaggaggcagaggttgcagtgagtcaagatcacaccattgcactccagcctg

SEQ ID NO: 48923 - DNA, 201 bp, Homo sapiens
cacgtcatggaccccagggcccctgggcttctttcctgccctgccagtgtgcagaggcgtgtatggttgggggttcctccctgctcgctgggctcactggaagagattggtcagagaggcatgaattagtctggaaggcccgttgcggcccactgctgcgaccccactgccctgcacagcccagagcctgaccatggaaga

SEQ ID NO: 48924 - DNA, 201 bp, Homo sapiens
ccctggctgacgtgtcttcttgttccaggggctaggcgtgtgcctgcccctccgcccctggccccatacctctcatagccgctgaccaggcctggctgacygccctgtctcgttccctccccaggattggcctctctcagctggaaggcttccgcagacagctcctggatgtcctgcagcgaagcaccaagcccaaagtga

SEQ ID NO: 48925 - DNA, 201 bp, Homo sapiens
atgaacttccgtacatcttgtatgtggactactccacaataatgaggaaagatggcggtaggaaaatgtttaaggagaagtgctcaccttttagttcagtaaaaaaaaaaatggtagatgccgaatggtcccacaattagatggaggaaaaaaaagactagaaggatgttaatagttgatagttttcctagagggatcatg

SEQ ID NO: 48926 - DNA, 201 bp, Homo sapiens
tacatcttgtatgtggactactccacaataatgaggaaagatggcggtaggaaaatgtttaaggagaagtgctcaccttttagttcagtaaaaaaaaaaayggtagatgccgaatggtcccacaattagatggaggaaaaaaaagactagaaggatgttaatagttgatagttttcctagagggatcatgggtgatttata

SEQ ID NO: 48927 - DNA, 201 bp, Homo sapiens
  misc_feature (1)...(201): n = A,T,C or G, or insertion/deletion polymorphism (see Tables 1-2)
caccccagtctgttctgaccacagccttgagagggatgttgttagccccattttacaagagaagaaactgaggtcccagaacagttcatctagccagaggngggggagagggttctccctgagctgtcagggaagacactggggtgggaacccagcctgacagtcaggaagggagggacgtttccccagaagggaagggtg

SEQ ID NO: 48928 - DNA, 201 bp, Homo sapiens
  misc_feature (1)...(201): n = A,T,C or G, or insertion/deletion polymorphism (see Tables 1-2)
agggagcttctgtggatgttgctggcttctaggagggttaggcatcttcaagatcgtgaaagagaggatctcagcccaggctccctgtggtgacacgctantaatgctgttgtcactggggagtttgagtggggtatgtagtgaggtagaagggagcaggctggcttgggggcttgggttgtgtgtccagcacctggcagt

SEQ ID NO: 48929 - DNA, 201 bp, Homo sapiens
  misc_feature (1)...(201): n = A,T,C or G, or insertion/deletion polymorphism (see Tables 1-2)
tcaccacagctgctgcagagcaacagggactccaccgctggaggcaggagagccagccgcaggtgactgaagtaggcacatggttgatgcctccctgcagntttatctcctgtgagggagcttctgtggatgttgctggcttctaggagggttaggcatcttcaagatcgtgaaagagaggatctcagcccaggctccctg

SEQ ID NO: 48930 - DNA, 201 bp, Homo sapiens
  misc_feature (1)...(201): n = A,T,C or G, or insertion/deletion polymorphism (see Tables 1-2)
tctgtcaccacagctgctgcagagcaacagggactccaccgctggaggcaggagagccagccgcaggtgactgaagtaggcacatggttgatgcctccctncaggtttatctcctgtgagggagcttctgtggatgttgctggcttctaggagggttaggcatcttcaagatcgtgaaagagaggatctcagcccaggctc

SEQ ID NO: 48931 - DNA, 201 bp, Homo sapiens
ggcaggagtaaaatgggggcccagggaaggtggctctctggatctgtctgagagtctcctctctgtcaccacagctgctgcagagcaacagggactccacygctggaggcaggagagccagccgcaggtgactgaagtaggcacatggttgatgcctccctgcaggtttatctcctgtgagggagcttctgtggatgttgc

SEQ ID NO: 48932 - DNA, 201 bp, Homo sapiens
tactttggcaaccaggaagtgtggcgtccagtgctagttttacatatagcaaccgtgggggcccttatgtctcacatgtgtgcaatggactcatcctcccsgccctcaattttgatttactggggcctagaggggttgggactttctgtcctggggacactgctcttcattcagcaccaggcagctctaggatgtggctgg

SEQ ID NO: 48933 - DNA, 201 bp, Homo sapiens
  misc_feature (1)...(201): n = A,T,C or G, or insertion/deletion polymorphism (see Tables 1-2)
actattttggaccaccttccaatttcaaagccctttcacataggaatcccattcgtcatggaaatgggagtcctgggctctcccttcaggacaccaagggncaaaaaaccctgcagagcgaaaaagagcccttacaaacttgccagtttccacatttactttggcaaccaggaagtgtggcgtccagtgctagttttacat

SEQ ID NO: 48934 - DNA, 201 bp, Homo sapiens
  misc_feature (1)...(201): n = A,T,C or G, or insertion/deletion polymorphism (see Tables 1-2)
gagccttggtaataaatggagccctggtgaagccttctggggagaggcctggagcacaggccctgcaacctcaggcctggctctgccgctgaagagctgantggccttgggcaacttatttagcctctctgggcctccatttcttcatccataatacagggcataagaggttgttaaaaggattacattaaaggaggtaat

SEQ ID NO: 48935 - DNA, 201 bp, Homo sapiens
acattgcccctgcccggtctccccccggctctccagagagcctctctgctcagatcatgcccctcacgagaaccacccacttcacaccggttcgacagacraatcccctgaattcctttaccaagttcagaagtgtctggtcctggcctcttgagatgacagagcactttaccagggtgagctgctagcatttttgctgct

SEQ ID NO: 48936 - DNA, 201 bp, Homo sapiens
  misc_feature (1)...(201): n = A,T,C or G, or insertion/deletion polymorphism (see Tables 1-2)
ggaatgtcctcaggggcttgatgttttgggtagaaggggagcatctggaaatatggggaaacctcagattttggaaaagtggctgaatcttggaagaactngaagctgcatgctcgtttgggcttctcggcctttgggaagcaggcggacgccagggcctgggccccctttcccagccatgcagccgggcctgggccagtg

SEQ ID NO: 48937 - DNA, 201 bp, Homo sapiens
gagagccaccaagaggaggcagcgtaacctgcggacctacaacctgcggtcagtcagcgggctgggtgggcagtcccagggtgggctttgctgtctggtgygcagaggtctccattcttcagaaggctaccccaggcctcccagactgcatgccaacctcgtgtgagccgtgggcattagtcaaagggcttaactgctccc

SEQ ID NO: 48938 - DNA, 201 bp, Homo sapiens
ctggaggcggccctgggcagtggcggcgtcactcctgagcggccccccagtgctgcggccaatgacgaggaggaagaggttggcggtgggggtggcgggcyggcctcccgcggggagctggcgctgcacaatgggcgcctgggggactcgcccagtcctcaggtgctggaattcgccgagttcatcgacagcctcttcaac

SEQ ID NO: 48939 - DNA, 201 bp, Homo sapiens
gggcgacaacaaggccttcaatgaggtgatcatctcgccagccatgctgcatgagcacctgccctatgtggtcatggaggggctcaacaaggtgaggcagytcccggcagggtaccaccagggaataaggcactgtcaccccatcagaaccccgtaagcaccatcagatcactgcccgattttacagacaagggtgctggg

SEQ ID NO: 48940 - DNA, 201 bp, Homo sapiens
  misc_feature (1)...(201): n = A,T,C or G, or insertion/deletion polymorphism (see Tables 1-2)
tccaccagcccaggcgggaggggtggctggtccagcaaggggttccttgcactccctccgcctcgcccgccccagctaagacagctagagcctctgcaganctctcatgtgattctcaccaggactttaggaggtagggataatcgacattttacaaatcgacattttacagttgaggaaactgaggcacgactaataagt

SEQ ID NO: 48941 - DNA, 201 bp, Homo sapiens
tcatcctccagatgaagacactgagtctcttagaagagaagtcatttccccaggtccttccccttctcacttatagccaggccatggctgaggtgccctcrgggcccccggttgggagagggcttcagtctcctggctgcatcctgagaacgtagctttctgtgctctttcctggaggtgcgccctccctcccacaggatg

SEQ ID NO: 48942 - DNA, 201 bp, Homo sapiens
  misc_feature (1)...(201): n = A,T,C or G, or insertion/deletion polymorphism (see Tables 1-2)
gaggtaaagacctgggttctgggcctaggctgtgtggctgtgggcaagtcacttcagctcatctgtcaaataaggggaagggtagtacctacctcacaganctgttatgaggactaggtgagttcatgtttgtaaagggcatagatgtgcgccgagaccttgtaggcaattcataaatgttaggagaaccgaagcagccca

SEQ ID NO: 48943 - DNA, 201 bp, Homo sapiens
tctcagtgtctcatacaaaatacctttcgcctgctgtgggccaggaatgtcctcaggggcttgatgttttgggtagaaggggagcatctggaaatatgggsaaacctcagattttggaaaagtggctgaatcttggaagaactagaagctgcatgctcgtttgggcttctcggcctttgggaagcaggcggacgccagggc

SEQ ID NO: 48944 - DNA, 201 bp, Homo sapiens
tgaggagtgttaggaggtgacatgagatgatgctggcttgtgacagactcagcatcgtgcttctttgatgggcacacagatcactggggagcttgccaacrcagattccagtttaggctggctgggcccagatgtgcatttctaacaactcccaataatgctgctgctgcaggccctggagcacacctcaccttgagtctg

SEQ ID NO: 48945 - DNA, 201 bp, Homo sapiens
accttgttactcccactgttgtccaaccgaccttcaccgaccctgtacctcgccggccgtggcaggcggctttcaggctcgcacagcatggctcctctcaycccacacgcccctgccagtgccactccagattgttctctttgctgcctgcctgctacaccatgcagtttagaacacagcctaatggagggctcggggcac

SEQ ID NO: 48946 - DNA, 201 bp, Homo sapiens
cgaggccagacagcgacctgctggtgagcccaccctagctggggtggagcctctgaacacaacgcctctgctggggggcgggccaccagtgtcctgcgggycaccactggggggcccagcctcactgtgctgagtcccgcagatcagatgcccacccccagaccagataagctccagtgcccaacaaggcacattcaaaat

SEQ ID NO: 48947 - DNA, 201 bp, Homo sapiens
gtggcctgcagtgctgtacatgtttacagaagctgctgggcttggctcaggatgtgttctgggcttgcaagccccccgcccaatcatgtgttcagtagccrtcctctgagcagggcccaaggcagccaggggcctggaggggccagaggagggtggggtcagggccgccccttctctgccttgtgcctctcatgctgcctc

SEQ ID NO: 48948 - DNA, 201 bp, Homo sapiens
agggcttctcggaggggcggctgctgtcgccagtggttgcggcggcggcccgccaggacccggtggagctgctgctgctgtctacccaggagcggctggcrgcggagctgcaggcccggcgggcaccactggccaccatggagagcctctcggacactgagtccctgtacagcttcgactcgcgccgctcctcaggcttcc

SEQ ID NO: 48949 - DNA, 201 bp, Homo sapiens
tctcattccactgtggcctcatgagtgacctggggcaggctcatgagtgatctggggcagccagtctatcagagcctcattctcacattggtacaatgacrggggttctggtgcagagaaccccagcagcactcctgaagtcctagtgctgccagcagggccttagcccctcagggaccccgcggctcaacccagcatcaa

SEQ ID NO: 48950 - DNA, 201 bp, Homo sapiens
tataagtacacaggtcaccccctacagacatgcacatgtacaagacacacaccaagacaaaggtggagacacatatacaaggacacatgtggacaggcagstgctcatggaaatgcatgaatacacctgtgcacagacccagacacacaagccagctgacatacacagacgtctggtctacacactcatacacatgaacag

SEQ ID NO: 48951 - DNA, 201 bp, Homo sapiens
aatggcgcgaccttggctcactgcaacctccacctcccaggttcaagcgattatcctgcctcagcctcccaagtagctgggattacaggcgcctgccaccrtgcccagctaatttttgtatttttagtagagatgggatttcaccatgttggccaggctggtcttgaactcctgacctcaggtgatctgcccgcctcagcc

SEQ ID NO: 48952 - DNA, 201 bp, Homo sapiens
gccggagtgcaatggcgcgaccttggctcactgcaacctccacctcccaggttcaagcgattatcctgcctcagcctcccaagtagctgggattacaggcrcctgccaccgtgcccagctaatttttgtatttttagtagagatgggatttcaccatgttggccaggctggtcttgaactcctgacctcaggtgatctgcc

SEQ ID NO: 48953 - DNA, 201 bp, Homo sapiens
ataaggagactcccaggggcctgtccctgaggcaggctcagctcagaggcccggaaggccacctggcccttaacagatgaatgggcaagcagcgacagccrcagccatcccctggctgcggaaaggctgaaggcaggtagggcaggagcactcgccgggctgtggggcgagtcgtgaccagatgggcaagtctcaggcctt

SEQ ID NO: 48954 - DNA, 201 bp, Homo sapiens
gggtgctggggctcagagaagtaggtagctgggccagaaagccccactcaaatacttcaacctcacacccctggctctgtccacatcaccacgttgccccrtggtggggaggagataaggagactcccaggggcctgtccctgaggcaggctcagctcagaggcccggaaggccacctggcccttaacagatgaatgggca

SEQ ID NO: 48955 - DNA, 201 bp, Homo sapiens
ctgccccagcagtgcccggcctcgcccgcgcagagcatgtgacttggcagtgcctgggcctggcatgcctggcgtgccagggcagcggcagcagcagccgractgtcagtaaggagctggagaggcccccagagccctcctgttggggcactggtcctgggttgtgggggtgacgggatgcatcagtgagacttttgtatg

SEQ ID NO: 48956 - DNA, 201 bp, Homo sapiens
cacatgggcctcatcccatttaaccttcacaaaggccatgtgcggtgggcatccctggccctgaggtcctttgacttgctccaagtcacccagccaaggcrtggcccagcagagactccaggcctaggtccgcctcaccctttgcagactcatgccttgcctgttcttccctgcgctgcttctgtcacctcacagtcaggc

SEQ ID NO: 48957 - DNA, 201 bp, Homo sapiens
agctgagcacccacatatccagaccctcttctgtgccaaatcctttctcagtggtcccacatgggcctcatcccatttaaccttcacaaaggccatgtgcrgtgggcatccctggccctgaggtcctttgacttgctccaagtcacccagccaaggcgtggcccagcagagactccaggcctaggtccgcctcaccctttg

SEQ ID NO: 48958 - DNA, 201 bp, Homo sapiens
tgcttccctggtcattcccatgttggtctgaggggtatccatggcctgtctcacccgctccctgcagtgcttcatacctcccccgaggagttgctgggcacttcagctcatgtctggaaagctctcttaagtgcagagtccattaaggaggaagcctacagcctccctgttgtgaatattcagtattcaagtctcctcagc

SEQ ID NO: 48959 - DNA, 201 bp, Homo sapiens
  misc_feature (1)...(201): n = A,T,C or G, or insertion/deletion polymorphism (see Tables 1-2)
ttgtctgacatttcttgagcagctgctaggcaccaggcgtggtgctgggtgccaaggacacagagatgcagagtgtagccctgccctcctggagctcccancccagtggggagcccggaatggagggggcactgattaggtctgcccttgggggttggcgggccctggcagcttcacagaggaggttgtgtttaggctgag

SEQ ID NO: 48960 - DNA, 201 bp, Homo sapiens
cctcaggtgatccacccgcctcgctcggcctcccaaagtgttgggcttacaggcatgagccaccgcgcctggccaaacaaaggcatcttgtagcactctcttatctgaatagcgctggcgcccctcagagagagcatgtgtgttcccctcactgatctgtgtcctcactgaagcataacaatcatggcgaaataacattta

SEQ ID NO: 48961 - DNA, 201 bp, Homo sapiens
cagtgactctgatgaggctgttggctgtgcaaattcctttgtgggtagccccagggtaaggtggccctggaaaggaatgtggttggtaggcccaaccctayccagcctcctgagcttggcccgctgctgtggtcaggagcatagaagccgggccagggcgagggaaggcctggcctaaactgagatgggccctccaggcaa

SEQ ID NO: 48962 - DNA, 201 bp, Homo sapiens
tatcctcagcccaaatcgagctcctggttcttccgcccgagttcccacttcctgcctccaactgtgtctgcagagcctgcagcctttggaggtgggacccyccccaacccaacctggccctgtgctctggctctgtgcccgcagacagagtgggctgagagggaacaaacacagccacaggggcaggctccaccatgctcc

SEQ ID NO: 48963 - DNA, 201 bp, Homo sapiens
agctttcaggcccctaacttgggttgcacacacccaggtacaggctggtggcgcacgtggcccccagcccacacgtgctttctctccgtcgtctcccttgycacctctcccctcctgtgctttcagaggccagcctctcggccactgggaagaaggggaaggtactgtagccccgggagcctggggtgggacctgtgggtc

SEQ ID NO: 48964 - DNA, 201 bp, Homo sapiens
agattgttctctttgctgcctgcctgctacaccatgcagtttagaacacagcctaatggagggctcggggcacctgagcagctgcctgctccatttcttcrcccctttaatccctcccttccccaggtgaaccctattcagcaggcttccggcagcaataacaaagctgggcacccagcccaccagctgctcagtgcttta

SEQ ID NO: 48965 - DNA, 201 bp, Homo sapiens
ggggccttctgagcccctgccccttcctggaggccttgtgcttgggtccagctttgccctgcctggggtgatgggaggggatagggaggtctgaaggacaraatagtcagctgtaggcccaggtctctaagcttctgggtcagtgacttttttctgtggccccttttgccctcctggctcaggcgaggggaggaaatgctg

SEQ ID NO: 48966 - DNA, 201 bp, Homo sapiens
tggcaaggctcccggggcactggctgggaatcctctgctttctcatcagctttactcggagcgcatttcagtgctgggctggggctggggaagatgacacrtgctgccagggcctgaagaaaagggcagagcccttggacttgtgggtgggggcaaggcatgcctgccatcgctcattggaaattgtggccaggctactgt

SEQ ID NO: 48967 - DNA, 201 bp, Homo sapiens
gccagtcacagggagagacttgatgtctggccttttaattcctcctctgccagggtgggtcctgggacctctaatgtgggcatgtcgtccaccccaggacragccatcagggacagaccccccacccccaaggctgcagccacaccatgtttcaggcttggggctggggcaggcttgggctcaatcctgggcacccagggg

SEQ ID NO: 48968 - DNA, 201 bp, Homo sapiens
caccatgttggccaggctggtcttgaactcctgacctcaggtgatccacccgcctcgctcggcctcccaaagtgttgggcttacaggcatgagccaccgcrcctggccaaacaaaggcatcttgtagcactctcttatctgaatagcgctggcgcccctcagagagagcatgtgtgttcccctcactgatctgtgtcctca

SEQ ID NO: 48969 - DNA, 201 bp, Homo sapiens
agtagctaggactacaggcatgtgccaccatgcccagataaatttttttttttttaataaagacaggttccccgtatgttgcccaaactattctcaaactyctggcctcaagtaattctcctgcgtcagctgcctgagtagctgggactataagcatgcaccaccacatctggctaaattaaaaaaaattttttttgtaaa

SEQ ID NO: 48970 - DNA, 201 bp, Homo sapiens
agggagctggggttcagtcccctctcccttctgagtcttataccccctgctctcctctccctctgcaggagcaagtcccagtctgagatgagcctggaggkcttctcggaggggcggctgctgtcgccagtggttgcggcggcggcccgccaggacccggtggagctgctgctgctgtctacccaggagcggctggcggcg

SEQ ID NO: 48971 - DNA, 201 bp, Homo sapiens
ctacacctggagacggtcctggccagggagcctgcggctctggggtggaggtcgggacggtggccctccgctgtgtaaggtgagacaggatgctgcctcgrattcatcctgaatgggcccctcgtcattgtctctcctggagccatttaattaattgatgattgatgttcctggacttccttgaggttaatctattattga

SEQ ID NO: 48972 - DNA, 201 bp, Homo sapiens
aggaaccctcagtatatcttgtttgttctcacattcgagggaagttggcaaagggcagttctgtgtcacagggaagggggtggatgaggaccccgaaaacmtgccctttaccgagtctcacccccgagcctgctgaggtcacacagcggcagtcagtggggggttaggttttcttgttttgtttttagagacagggttttg

SEQ ID NO: 48973 - DNA, 201 bp, Homo sapiens
gcaaggtttgcgtgaagcacatctttgggccatcccagcctccttggcagcgagcaggcagcggcaggcactgtcagtggggtggaggtgttgcaattacsgtgtgtagggggctgggggaggactgagcagacagaaatgtggagtgtgcggcttgtgagctggcctgtgggggcagtggcagcagagctgcgtggggtg

SEQ ID NO: 48974 - DNA, 201 bp, Homo sapiens
cacacctcagttgtcacttggtttcaccaagggaattcctcgaagacagctgtgagcaaggtgggggctgcgccaggagagagaataggagcaggcaagtsggtagacctttcccactgtgctccttcagacggctgggccctggctcctccctccagggtcggcttcctcccctgacacagctggtgagctgggccgtgc

SEQ ID NO: 48975 - DNA, 201 bp, Homo sapiens
tagtcctgggcttttgtcaggccaggcctggcaggtccagctggactcaactccagggtgtgtttggcctcggacttgtggagtgatccagaataagtccyttcccctcactaggcctgtctccccatctactagatgaggggttggctgggcttccagccccttgccagccctgaaattcaacaattccatgtcatctgt

SEQ ID NO: 48976 - DNA, 201 bp, Homo sapiens
tctggggaggtggaactgctcccaccagattagtcctgggcttttgtcaggccaggcctggcaggtccagctggactcaactccagggtgtgtttggcctyggacttgtggagtgatccagaataagtcccttcccctcactaggcctgtctccccatctactagatgaggggttggctgggcttccagccccttgccagc

SEQ ID NO: 48977 - DNA, 201 bp, Homo sapiens
cagctttggtgccctagaccctgtggcaggcagggccctgggccaggtaccaggtgccaggcagtgagcagggcagcaaagctttgtgggactttgcctgyctggaggagcctggttctggggaggtggaactgctcccaccagattagtcctgggcttttgtcaggccaggcctggcaggtccagctggactcaactcca

SEQ ID NO: 48978 - DNA, 201 bp, Homo sapiens
  misc_feature (1)...(201): n = A,T,C or G, or insertion/deletion polymorphism (see Tables 1-2)
ggcttttaagcctcatagctgcagaaccgtttgtcagaaggaaacatggagaggctcaaaatacagagcagagagaaggggtgctgctctacctagggggnaactgagtcctgcccactggccacggtctgtgcaggtagctcctgaggtgccaccagctgccctttccaaagcaaagcaggctctggcctcaggagactt

SEQ ID NO: 48979 - DNA, 201 bp, Homo sapiens
  misc_feature (1)...(201): n = A,T,C or G, or insertion/deletion polymorphism (see Tables 1-2)
cggcttttaagcctcatagctgcagaaccgtttgtcagaaggaaacatggagaggctcaaaatacagagcagagagaaggggtgctgctctacctaggggngaactgagtcctgcccactggccacggtctgtgcaggtagctcctgaggtgccaccagctgccctttccaaagcaaagcaggctctggcctcaggagact

SEQ ID NO: 48980 - DNA, 201 bp, Homo sapiens
tggagagcctctcggacactgagtccctgtacagcttcgactcgcgccgctcctcaggcttccgcagcatccggggctcccccagcctccacgctgtgctrgagcgtgatgaaggccacctcttctacattgaccctgccatccccgaggaaaacccatccctgagctcgcgcactgagctgctggcggccgacagcctgt

SEQ ID NO: 48981 - DNA, 201 bp, Homo sapiens
acagggcgttgctgtagggtcttaaaaagaaaatgatgtggctcaacttatcttaaaagggccactctgttgctgagctgagagcgtaggggcaagtgcarggaggccagtcgaggccaccatgacagtcccaggcagagctgccagggcaggggtaggggaggtgagggagtgcctggagtccagctctgagtctgaagg

SEQ ID NO: 48982 - DNA, 201 bp, Homo sapiens
  misc_feature (1)...(201): n = A,T,C or G, or insertion/deletion polymorphism (see Tables 1-2)
tgggtgctggggatacagctgtggacctctctgtggtgctcactgcccagcgaggaggcggacagcgcatagacaaggcaaatagggcacatggtggagcngatgggcactttggacccacataaagccaggtgcctgggatggggagtgctgggggcctggggagccctggctgttagatgaggtggcaagagagacctc

SEQ ID NO: 48983 - DNA, 201 bp, Homo sapiens
  misc_feature (1)...(201): n = A,T,C or G, or insertion/deletion polymorphism (see Tables 1-2)
tgggactggcctggatggctgtcctgggagcccctgcccaccctgacagagggagctgggcctcccctcatcctctgtaactcccgccttcaccagactcnaggacaccctggccctgctgaggcatacagagcttcagcccagcacagaagcaagacaaaatcagtggctcttagagtttagaaaacaagacagactctc

SEQ ID NO: 48984 - DNA, 201 bp, Homo sapiens
gtggtgcagctgtctgcacaggtaggtgatgggcacggccttcggactggttatgggataggtggccagctcgtgccggcatggtggtgccgctagcatgrgtgtgaggaagtgctgccattgcttgggtgttgggatggttctggccttgggcttgacatgatctggggtgatagcactgggggcttgaagaattggtgt

SEQ ID NO: 48985 - DNA, 201 bp, Homo sapiens
tgccacgtgtagtctcccatctccccatttattcaaggacatttattgagcacctacttgccaagccttgtgcctggagctgggaataatggtatcacttygtcctgagggagttcctgggttggcataagcggacactaccactctaccagcagccacaatggcaaaagctatgtggtgagtcctctctgctacacagtg

SEQ ID NO: 48986 - DNA, 201 bp, Homo sapiens
tcatacctttgaaaagaacttgcttctcctttgacaccttcgctgggactggggccagaccgtggagcagataatagttttgccacgtgtagtctcccatytccccatttattcaaggacatttattgagcacctacttgccaagccttgtgcctggagctgggaataatggtatcacttcgtcctgagggagttcctggg

SEQ ID NO: 48987 - DNA, 201 bp, Homo sapiens
ggctgccagagccagcaaggagcggggagggcagggcaggcctgtggctgggatcgggaggagatccccagtgaccctgggagcccgtcagcctttctggyggcagaggctccgtggctggtggagccagagttcctggccaggaaggagacctgcctaggtcactttccctgagtgtggccccaccagggccgctcaggc

SEQ ID NO: 48988 - DNA, 201 bp, Homo sapiens
  misc_feature (1)...(201): n = A,T,C or G, or insertion/deletion polymorphism (see Tables 1-2)
ctggaaggagggcaggggcagggcccttcaggaatgaggtagggtgtgcatccctgcgtgccccggtgagaccctggaaagccagatacccagagtgtggntgacaggctccgggccagagcccaggggctgtggtgaccgttctcccacctccttccccgctgatgttcaagggtgagggaccagaggcccaaagacggc

SEQ ID NO: 48989 - DNA, 201 bp, Homo sapiens
gggctcggctcccacgcagctccccagtgaccacgcactctcttggaccctggaggtcacctttacctctggctccccctgccttcctgagcttgtccttyggccaggctttccgtgactactactctagggactttctgggtcgtgcatggctgcctctggggctggccctcaaaggacttctaaccacaggcttagtgg

SEQ ID NO: 48990 - DNA, 201 bp, Homo sapiens
ctcaggtgatccacccgcctcgctcggcctcccaaagtgttgggcttacaggcatgagccaccgcgcctggccaaacaaaggcatcttgtagcactctcttatctgaatagcgctggcgcccctcagagagagcatgtgtgttcccctcactgatctgtgtcctcactgaagcataacaatcatggcgaaataacatttag

SEQ ID NO: 48991 - DNA, 201 bp, Homo sapiens
tacccacttccctgcctgggaagagcgagaggcctggtcttcaggaagaaccatggagaggggaagcctggaagataaaagctgggggcctggcaaaaccyaaacatgtgcacgtctccccgccagtggaggggctctgcctggggagcaccaagcacctgtgttctggtgattccaggaagcagccccacgggccctctc

SEQ ID NO: 48992 - DNA, 201 bp, Homo sapiens
  misc_feature (1)...(201): n = A,T,C or G, or insertion/deletion polymorphism (see Tables 1-2)
tgcctgggaagagcgagaggcctggtcttcaggaagaaccatggagaggggaagcctggaagataaaagctgggggcctggcaaaacccaaacatgtgcangtctccccgccagtggaggggctctgcctggggagcaccaagcacctgtgttctggtgattccaggaagcagccccacgggccctctctgtgtactcgca

SEQ ID NO: 48993 - DNA, 201 bp, Homo sapiens
gcctctctgtgctgcattccttccttcagggtatggggcaggattctgagtgggggtcttatgatctactatcaaacaaagtaggtcagagaatttctttytttttttttttttgagatggagtctcactctgtcacccaggctggagtgcaatggcacgatctcggctcatggcacctctgcctcccgggttcaacagat

SEQ ID NO: 48994 - DNA, 201 bp, Homo sapiens
aagcgattctcccgtctcagcctcccaagtagctgggattacaggcacccgccgtcatgcccggctaatttttgtattttagtagagacagggtttcaccrtgttggccaggctggtcttgaactgctgacctcaggtgatccacccacctcagcctcccaaagtgctaagattacaggcatgagccactgtgcccggcgc

SEQ ID NO: 48995 - DNA, 201 bp, Homo sapiens
acccgggaggtggaggttgcagtgagccgagattgcaccactgcactccagcctgggtgacagagcgagactccatctcagaaaaagaaaaaaaaaaaaaagagtctctgagtttacagatgagggccctggcattcagagaggctgaggaactcacccagcctgtcaacggcagaaccagagccaaatccaggatttgct

SEQ ID NO: 48996 - DNA, 201 bp, Homo sapiens
aagctatgttctcactcactccctaaggaggctgtgggcagaaggaaccctgggctgggaggcagcacagggcttggtatttatactagacctgttctgcytcagtttcccagtctgtaaagtggccctttgtctcaggcaatttgtgctaagacccaagagccttaagtgtgtgggatactagagggtctcccctgatgt

SEQ ID NO: 48997 - DNA, 201 bp, Homo sapiens
gagccaaatccaggatttgctagcttcaaagctatgttctcactcactccctaaggaggctgtgggcagaaggaaccctgggctgggaggcagcacagggsttggtatttatactagacctgttctgcctcagtttcccagtctgtaaagtggccctttgtctcaggcaatttgtgctaagacccaagagccttaagtgtg

SEQ ID NO: 48998 - DNA, 201 bp, Homo sapiens
  misc_feature (1)...(201): n = A,T,C or G, or insertion/deletion polymorphism (see Tables 1-2)
gggagagcaaagatataaaaaatacaaagctgaactcttaagtagttactataatttatattgtatttaggattgaggttcctggttgccgacatcaaaangggaaatcctagaatctcagaaccagacctgtgagaccaatttggcccactccctttttttctgtggcgggatctgaggctcctcatggggtaggcacat

SEQ ID NO: 48999 - DNA, 201 bp, Homo sapiens
cccccacccctccaggttgcaggaagtgaactccatgctcaacaagcgactcaaggacgccctcttcacggaccagtggagtgagctgttcatggatgcgmtagggcccttcaacttcgtgctggtaacgcacccctcaccccctggacagccagagaccctgctgaattcctggctccagctgtaccctggctcactgtg

SEQ ID NO: 49000 - DNA, 201 bp, Homo sapiens
actcagggaagaaaggggcctggaggagcagctgaacagcatggtggggtcactggcttgtccagatcttgatgccacactgggagactgctgggatcagmcattatagggtcacaacactgattccacaacactgatcccccaggtgggtttccgccattgcaaggactatgtggcttatgtctgggccaaacatgaaga

SEQ ID NO: 49001 - DNA, 201 bp, Homo sapiens
acccctgggcctaccaggtaacattcagtgaggaatcactgcccaagggccatggagacttcatcctgggctactatagtcacaaccacagcatcctcatyggcatcactgaacccttccaggtaagtaggccagactgctgggctgggggtgcctaaagacttttgtcaaatgccacagcctctacattctgctccttga

SEQ ID NO: 49002 - DNA, 201 bp, Homo sapiens
tctcccctgatgtggccccctgcccctgccttgcctggacagtttgccttcagggacgacatgccactggtgcggctggaggtggcagatgagtgggtgcrgcccgagcaggcggtggtgaggtaccgcatggaaacagtgttcgcccgcagctcctgggactggatcggcttataccgggtgagaggggcagtggtggtc

SEQ ID NO: 49003 - DNA, 201 bp, Homo sapiens
gcagcccccagaactcccctccaccccttccccggtgcccagtccagttctgtctccaactcaggaacaggccctggctccagcatccacggcatcaggcrcagcctctgtgggacagacatcagctagaaagagggatgccccagcccctagacctctccctgcttctgaggggcatctccagcctccagctcagacatc

SEQ ID NO: 49004 - DNA, 201 bp, Homo sapiens
ctctgggaatgggtaagagaacagagagggctgtaaccaagggatttggatgtttagggggcggtggggaactgagggtttctgggcattatgaaggaagrgagaggtatttaacaagctgcacctgtaggtctgtatcttgacaatagaaaaagaaaagaaacaggctgtccccagtgtgcccagacctgggatgtcagg

SEQ ID NO: 49005 - DNA, 201 bp, Homo sapiens
acactgattccacaacactgatcccccaggtgggtttccgccattgcaaggactatgtggcttatgtctgggccaaacatgaagatgtggatgggaatacmtaccaggtacttaaaaggagtgggagagtcagggcaagtccttgttgcctttgggacctcagaactcaccttgggggctctcaggtggcctccctgaccc

SEQ ID NO: 49006 - DNA, 201 bp, Homo sapiens
  misc_feature (1)...(201): n = A,T,C or G, or insertion/deletion polymorphism (see Tables 1-2)
ccaagccaccccgatcacccagccgttccccaagccactccccgaatcgctctccctgtgttcccccagcccctgacatggccctcccaaggcttggcacncagagtacagggcctggcaggtgcctgagccccaaccttcaggcccaagaagccccagccccagtcaccacctcctcttctacatccaccctgtcatcct

SEQ ID NO: 49007 - DNA, 201 bp, Homo sapiens
acctgttctgcctcagtttcccagtctgtaaagtggccctttgtctcaggcaatttgtgctaagacccaagagccttaagtgtgtgggatactagagggtmtcccctgatgtggccccctgcccctgccttgcctggacagtttgccttcagggacgacatgccactggtgcggctggaggtggcagatgagtgggtgcgg

SEQ ID NO: 49008 - DNA, 201 bp, Homo sapiens
aatccaggatttgctagcttcaaagctatgttctcactcactccctaaggaggctgtgggcagaaggaaccctgggctgggaggcagcacagggcttggtwtttatactagacctgttctgcctcagtttcccagtctgtaaagtggccctttgtctcaggcaatttgtgctaagacccaagagccttaagtgtgtgggat

SEQ ID NO: 49009 - DNA, 201 bp, Homo sapiens
agtggagtgagctgttcatggatgcgctagggcccttcaacttcgtgctggtaacgcacccctcaccccctggacagccagagaccctgctgaattcctgkctccagctgtaccctggctcactgtggggcccgctgggcctctgtggctgggtccgtgacatgggtgggtggaggagcagacctgaaggtgggcgcgagg

SEQ ID NO: 49010 - DNA, 201 bp, Homo sapiens
agtgtcttaaaaataacaaagaaaagatataaaaattcacatatataataagaccagcaaaatcaaactccatgtaacattcattcatattcattcattcrttatttactgagtacttaactgtcttaccatatgccaagcattatgagagtgtgtagtgatggggagggagagcaaagatataaaaaatacaaagctgaa

SEQ ID NO: 49011 - DNA, 201 bp, Homo sapiens
  misc_feature (1)...(201): n = A,T,C or G, or insertion/deletion polymorphism (see Tables 1-2)
cagggtgttgcccaaactggggcaccctccaaggtaagacccctgagacccagtgccccccgctttcctgatccctggttccacacaccccccccacatanactgcaggctccctggtgctcctgactgaggggctggtactttcctctgctcagcgagcaggggctaggtgaagagagcaccctgggggctgaggggcag

SEQ ID NO: 49012 - DNA, 201 bp, Homo sapiens
gtggagtgagctgttcatggatgcgctagggcccttcaacttcgtgctggtaacgcacccctcaccccctggacagccagagaccctgctgaattcctggytccagctgtaccctggctcactgtggggcccgctgggcctctgtggctgggtccgtgacatgggtgggtggaggagcagacctgaaggtgggcgcgaggg

SEQ ID NO: 49013 - DNA, 201 bp, Homo sapiens
  misc_feature (1)...(201): n = A,T,C or G, or insertion/deletion polymorphism (see Tables 1-2)
tcctcatcggcatcactgaacccttccaggtaagtaggccagactgctgggctgggggtgcctaaagacttttgtcaaatgccacagcctctacattctgntccttgagttcagacaaataacctgacctcccaagatctgccaacgagagaggcagacctcgggaggtcaggcctcagtggctgggttggggagcagggc

SEQ ID NO: 49014 - DNA, 201 bp, Homo sapiens
gtaccgcatggaaacagtgttcgcccgcagctcctgggactggatcggcttataccgggtgagaggggcagtggtggtcagcgactcagggaagaaagggscctggaggagcagctgaacagcatggtggggtcactggcttgtccagatcttgatgccacactgggagactgctgggatcagacattatagggtcacaac

SEQ ID NO: 49015 - DNA, 201 bp, Homo sapiens
ggaagaaaggggcctggaggagcagctgaacagcatggtggggtcactggcttgtccagatcttgatgccacactgggagactgctgggatcagacattayagggtcacaacactgattccacaacactgatcccccaggtgggtttccgccattgcaaggactatgtggcttatgtctgggccaaacatgaagatgtgga

SEQ ID NO: 49016 - DNA, 201 bp, Homo sapiens
gtgtattttgtctgtgtaatccttcatctcctaatgaccttgtgcagtgtaggtacttttttatgcccatttcatagatgagcaaatggaggctcagaggrcttaagtaactcaaggacacttaaggtagtcaccatggaaataagtagtgaagtcaagagtaaagcaagatgcttctgggcatcagagcctaccttcttc

SEQ ID NO: 49017 - DNA, 201 bp, Homo sapiens
ttaaattgagacggagtttcgctcttgttgcccaggctggagtgcaatggcacgatcttgactcactgctgcctcagcccagtatctgggattataggcaygcaccaccatacccggctaactttttatatttttagtagagacggggtttctccatgttagtcaggctggtctctcaagctcccaaccttaggtgatcgg

SEQ ID NO: 49018 - DNA, 201 bp, Homo sapiens
actgcttgaacctgggaaatgaaagttgcagtgagccgaggtcacgccactgcactccaggctgggcaacagagtgagactgtctccaaaaaaaaaaaaaraaagtaagatgggtttgtcaggataattacattctgtcaatttactaatggaaaaagttgtggctccaagttaaaaacaaaacttgtaggcatgaagtta

SEQ ID NO: 49019 - DNA, 201 bp, Homo sapiens
ttttttaaaaactcatttcatcaaacaataccacctctttgagaatctcacagtgggtcatgagccctatgagaacttttcctgtaagttcttacctagggtctggttgtaataatccagtgaatgttgaaaacaaactccagtgaatgttttattcctccagagcataacttaccatttcctcacaaatctgccctagtc

SEQ ID NO: 49020 - DNA, 201 bp, Homo sapiens
gagcccaggaggtagagactacagtgagctgtgatcgtgccactactctccagcctgtgcaacagagcaagaccccatctcaaaaaaaaaaaaaaaaaaaagacccccctccactatagaaaatatgaagttcccacgaagggaaccataatcctccccacatcccattggtattctagctttattaaggcttttttcctt

SEQ ID NO: 49021 - DNA, 201 bp, Homo sapiens
ctctgcctcccaggttaaagcgattgtcttgcctcagcttcctgagtagctgggattacacatacacgttccaccgtgcccagctaatttttttttcccccaccgagacagagtcttgctctgtcacccaggctggagtgcagtggcgcgatctcggctcactgcaacctctgcctcccgggttcaagcgattgtcgcgcc

SEQ ID NO: 49022 - DNA, 201 bp, Homo sapiens
ccagctactcgggaggctgaggcaggagaatggcatgaactcgggaggcggagcctgcagtgagctgagatcgcactactgcactccagcctgggcgacartgcgagattccgtctcaaaaaaaaaaaaaaagacttgaacccaggagtcctcaccagggtcttgtcctctaccagtggttttttgcactgtactttgagg

SEQ ID NO: 49023 - DNA, 201 bp, Homo sapiens
cttgaacccaggaggtggaggttgtagtgggccaagattgtgccactgcacttcatcctgggctacagagtgagattccatgtaaaaaaaaaaaaaaaaaatccccttgtaagttgtcatctaatgcattgaaaattggtaagattaggcagaggttttatctaacactaaagtttccttgccttgatgagctttcagtgt

SEQ ID NO: 49024 - DNA, 201 bp, Homo sapiens
aaaggaatatcttcattcttaggaaataggcactgcagtatttaggagtaaggcatcatgacttatgcaatttactctctagtcaaaaaaaaaaaaaaaaagctcgctcatatgtggaagccaaaaaaacttggcttcgtggagatagagaatagaatgatagataccagagtctgggaaaggtgtgtgggtgggatggca

SEQ ID NO: 49025 - DNA, 201 bp, Homo sapiens
agtggtgcgatcgctgcagccttgacctcaagtgaccctcccaccgcagcctcctgagtagcggggaccacacttggtgaattttttttttttttttttttaaacggagtctcgctctgtcacccaggctggagtgcagtggcgcgaactcagatcactgcaacctcagcctccctacaggtagctgggattacaggcgtc

SEQ ID NO: 49026 - DNA, 201 bp, Homo sapiens
aactctaagaggaaagattatattgaacaaaacattaactttgaataacctctcaatttcaaattctctttttttgtttttttttttttttttttttttttggagacagaggtcttgttctgttgccgaggctggagaatctcagcttactgcaacttccacctcctgaattcaaccaatttctcctgcttcggcctctca

SEQ ID NO: 49027 - DNA, 201 bp, Homo sapiens
taactctaagaggaaagattatattgaacaaaacattaactttgaataacctctcaatttcaaattctctttttttgtttttttttttttttttttttttttggagacagaggtcttgttctgttgccgaggctggagaatctcagcttactgcaacttccacctcctgaattcaaccaatttctcctgcttcggcctctc

SEQ ID NO: 49028 - DNA, 201 bp, Homo sapiens
ggattacaggcacccactaccacgcacagctaatgtttttgtatttatggtacctatggtactatagtgcctatagtcccaagtactcaggaggccaaagygagaggtttgcttgagcccaggagcttgaggatgcagtgaattatgattgtgtcactgcactccagcctgagcaacagagatcctatctcaaaaaaaaaa

SEQ ID NO: 49029 - DNA, 201 bp, Homo sapiens
tggttaacaagtgtattgtatatttcaaaacagctagaagggaggactttaaatgtctccaaaacataggaaggataaatacttgaggtaattgacacccragatatcctgacttgatcattacacagtttatacatgtaacaaaatatcacatataccccataagtgtatacaaatgtctgtatcaatttttttaaaatt

SEQ ID NO: 49030 - DNA, 201 bp, Homo sapiens
ggatttcatggcagagcctggagtagaatccaggggtcttggttcatcccattagctaactacagaatgtctctaggttgcccttgctatgtatttaaaayaaataaaaacaaataaaaacattaaaaactaagatgtcagatgccttaaatgttagcatctggcagtttcactttgtctccccatcctaaaaacaactga

SEQ ID NO: 49031 - DNA, 201 bp, Homo sapiens
ttccagatccacgagagcgtgtgaaagaagatgacttagatgttgttctcagccctcagagacggagctttggagggggctgccacgtgacagccgctgtyagctcccggcgctcaggaagtccattagagaaagatagtgatgggcttcgtctgcttggtggacgtaggattggcagtgggaggataatctctgcccgga

SEQ ID NO: 49032 - DNA, 201 bp, Homo sapiens
acctcaggtgatccacctgtcttggcctcccaaagtgttgggattacaggcatgagccatagtgtccggactgatctgctttctgtatctgctttctgttyctatagattagtttacatttcctaggattttatataaatggagttactatagtatatactccttgtatagcttttttcattaagaatagttacgatttat

SEQ ID NO: 49033 - DNA, 201 bp, Homo sapiens
ttccagcctttctgcaaataaagaaaaacttaaagaaagctgtaagtgtttatgaatatctgttttagatatctgaaaaggtctagatgttcagtcttcargcagttgggtctaacataacctctgtttcataaaaagtcaaatatatattgggtttttgtttaatgttcttttttaaaaactcatttcatcaaacaatac

SEQ ID NO: 49034 - DNA, 201 bp, Homo sapiens
  misc_feature (1)...(201): n = A,T,C or G, or insertion/deletion polymorphism (see Tables 1-2)
agaaatgggtcgcgtaaacttcggtgtatccatatatgggaatgttacattgcattgtcctgtaaaaccatgttgcagatgtgtttattggcaaataatgntcatgacgtactgactcatagaaaactctccatattgtatcctgtgtttggaaaaaacagactgcacagaaattctgtaaaagtacacaacagaacattc

SEQ ID NO: 49035 - DNA, 201 bp, Homo sapiens
  misc_feature (1)...(201): n = A,T,C or G, or insertion/deletion polymorphism (see Tables 1-2)
agcagaatcattaaagatatgcagagactttattaaaatgatgaaaactgagaaggaacctaaatatccaacagtagaaatgggtcgcgtaaacttcggtntatccatatatgggaatgttacattgcattgtcctgtaaaaccatgttgcagatgtgtttattggcaaataatgttcatgacgtactgactcatagaaaa

SEQ ID NO: 49036 - DNA, 201 bp, Homo sapiens
aagggactatattttctagaaatgtcactatcataagagacaaaagttgtagaaatgttctagattaagggagaccaaagagatacaacaatcaaatatckgattctagactggatcctgttttggagggggaagatcaatataaaggacattactgggtcaatttacaaaactggaattgggaaggtagattagaaaaaa

SEQ ID NO: 49037 - DNA, 201 bp, Homo sapiens
ataactctaagaggaaagattatattgaacaaaacattaactttgaataacctctcaatttcaaattctctttttttgtttttttttttttttttttttttttggagacagaggtcttgttctgttgccgaggctggagaatctcagcttactgcaacttccacctcctgaattcaaccaatttctcctgcttcggcctct

SEQ ID NO: 49038 - DNA, 201 bp, Homo sapiens
aataactctaagaggaaagattatattgaacaaaacattaactttgaataacctctcaatttcaaattctctttttttgtttttttttttttttttttttttttggagacagaggtcttgttctgttgccgaggctggagaatctcagcttactgcaacttccacctcctgaattcaaccaatttctcctgcttcggcctc

SEQ ID NO: 49039 - DNA, 201 bp, Homo sapiens
ttggtgtttatcactctgtgattagagcaataactctaagaggaaagattatattgaacaaaacattaactttgaataacctctcaatttcaaattctctytttttgtttttttttttttttttttttttttggagacagaggtcttgttctgttgccgaggctggagaatctcagcttactgcaacttccacctcctgaa

SEQ ID NO: 49040 - DNA, 201 bp, Homo sapiens
tacaacctctgtctcctgggttcaggcagttcttgtgcctcagcctcctgaatagtacctgggatttcaggtgtccaccaccaggcccagctagtttttttatttttagtagagacgtggtttcaccatgttggccaggctgctcatgaactcctgactcaagtgatagctggtctcggcctcccaatgttttgagattac

SEQ ID NO: 49041 - DNA, 201 bp, Homo sapiens
tcgatctcgtgacctcgtgatccgcccgccttggcctcccaaagtgctgggattacaggtgtgagccactgcactcagcatttttttttttttttttttttgagacagagtcttgctctgtcacccatgctgtagtgctgtggcatgatctcggctcactacaacctctgtctcctgggttcaggcagttcttgtgcctca

SEQ ID NO: 49042 - DNA, 201 bp, Homo sapiens
aagtcattgggaggacaaggtgggaggatgaattgagtccaggagttcacgaccagactgggcaatatagtgagaccccatctcgttaaaaaaaaaaaaaattgccagaggtggtggtgtgcacctgtggtcccagatactcaagaggctaacgtgggaggatcacttgagcttgggaagttgagcttgcagtgagctatg

SEQ ID NO: 49043 - DNA, 201 bp, Homo sapiens
attcagcttgatactgaccagtgttaaacatgcgtattaaagttaagtgaatgttgaattatcttagtttaacttcatgtggaatttttttttttttttttgagacaggctctcactgttatccaggctggagtgcagtggtacagttaactcactgcagcctcgaactctgcattcatgcgatccttccacctcagcctc

SEQ ID NO: 49044 - DNA, 201 bp, Homo sapiens
ggcggaaccccgagttacgccgcccgcggccgagcactaaagatgaggttccagctgggaggcggctgcgtacgaaagtcctccctccctcacttccggastcgtgcgtgggcctctctggcttttggttcacagggagtggaaaccggaacccgtggagtatgacccgcccatgcgtggacccggcaggttgctacaact

SEQ ID NO: 49045 - DNA, 201 bp, Homo sapiens
gctctgattacaggcgtgagccaccacgcctggcctcacatccatgttattttcgtcaagtgaatagactaatctgtttttttttgtttgtttttgagacygcgtctcactctgtcacccaggctggagtgcagtgttgcaatcttggctcactgcaacctctgcttcccaggttcaagcaattctcctgcctcagcctcc

SEQ ID NO: 49046 - DNA, 201 bp, Homo sapiens
aagcgattctcctgcctcagcctcccaagtagctgggactacaggtgcacgctgccacacccagctaattttgtttttgtatttttatttttatttatttwttttttttgagacggagtttcgctcttgtcgccgaggctggagtgcaatggtgctatctcggctcactgcagtctccgcctccggggttcaagtgattct

SEQ ID NO: 49047 - DNA, 201 bp, Homo sapiens
caacttaaattcatttcctaaaatgctgacaggtgaattctgaatggagaaaagccatcaaatgaagggaaaagaaaatcttccagtacttttttttttttgagatggagttttactcttgttgcccaggctggagtgcaatggcaccacctctgcctcctaagttcaagtgattctcctgcctcagcctcctgagtagct

SEQ ID NO: 49048 - DNA, 201 bp, Homo sapiens
gatctgttttggtatgacagcatgtaagttgatagaaaactttttccacattcagatttggtcttcccaaatatattttctctcaaacctgagagtgtttkagtagtgtttcacaacttaaattcatttcctaaaatgctgacaggtgaattctgaatggagaaaagccatcaaatgaagggaaaagaaaatcttccagta

SEQ ID NO: 49049 - DNA, 201 bp, Homo sapiens
ctgttgtacatactgtggtatgttcagtatgtggtagaaattccatcccaatccaaatcaatagaagaaatagatttaatagcggaaatatgattaaattstactgcaaggcatagggctttcattctatatggttttatttccgttcttgatttataaattactttttttccttgagtttgctaattagccatatggaag

SEQ ID NO: 49050 - DNA, 201 bp, Homo sapiens
ttctacagaatacagtacagttctgagtcccctttcctaactggaggtttttcagtcctgctatgaggtgatacttatttcccatgctactcaagttaatytaccagagttctagatatttgtccattcaggaccattttaggactccatgctaaagggtcagataatgaggtaaaggtcaaggtggttggatttttgact

SEQ ID NO: 49051 - DNA, 201 bp, Homo sapiens
taagtaagttaagtttttcttgaaaacccatggaaattgggcactgtggctcacgcctgtaatctcagcactctgggaggcagaggcaggcgaatcacaargtcaagagatcaagaccatcctagccaagatggtgaaatcccatctctactaaaaatacaaaactagctgggcatggtggcccacacttgtagtcccagc

SEQ ID NO: 49052 - DNA, 201 bp, Homo sapiens
acttgttctaagtttgggacaaagtgtaaccagataataagatgaagtaaattgacctctatgcaatttgggattactgttcctgcaaagtcagtgggaaragccaagtgttttctggctttttcctttgcctgttaggagagagggctgagaatccaacagaggttcagcatccggcctgcccagggtatataccccctc

SEQ ID NO: 49053 - DNA, 201 bp, Homo sapiens
aatgagatttattagaccagtgggaggccacaagtgtttgggagaggtttgccaaaatattttttgtttggttcctcacagaaaacctcctgtcatccagytctgtacccagtgccgatcgagactcttctcccactacaaattccaaactgtcagcattacagaggtcttcgtgttccaccccactgtcccaggccaacc

SEQ ID NO: 49054 - DNA, 201 bp, Homo sapiens
ctagccttcatgttttggatcagcatcagcctcttaggtcctccctgtgtacagttgtgtccctccaacaaacatgcctttccccttaccttgcttttttwaattgtattcatcactgtctagcatattatttattgtttgtctccctgcctgtagtaaccccactccatcctgcagccccaagaatgtaacctccatgag

SEQ ID NO: 49055 - DNA, 201 bp, Homo sapiens
agagttactattatacagtgtgacaagtactcagagatgacataaggattatagagaaggtagcaattaattttactaggtagggcaaaaatgggtaggcrgggcaagcttcccagagaaggtcacatttgaatttcgccttgaaggatgagctacaacaaccaacctgtaggcaagtgaaaattgccctcatgccaggtt

SEQ ID NO: 49056 - DNA, 201 bp, Homo sapiens
caagcagttctcatgcctcagcctcccgagtagctaggattacaggagtgtgccaccacacccggctagttttttgtatttttagtagagatggggtttcrctatgttggccagacttgaattcctggcctcaagtgattcacctgcttcggtccccaaagtgctgggattacaggcatgagccaccgcacctggcccaga

SEQ ID NO: 49057 - DNA, 201 bp, Homo sapiens
  misc_feature (1)...(201): n = A,T,C or G, or insertion/deletion polymorphism (see Tables 1-2)
tgtccagcctttaaaagtaatcactaccttaattaaaaataatttatcaccaaaatgcacatccctgaacactatagtttagtctacctttaaaatactcngtacttaatgttttgatgtgattcttaaagttactaccacagtgcctcagtgttttgcttcagctggttttacctgttaaccctttcagaagatactgag

SEQ ID NO: 49058 - DNA, 201 bp, Homo sapiens
gtatctaatttttttcagcttctgcttaacatacctttctaagagtgaagagaaacctttgtagaaagtgtggtgtccttactcttctcctgaccctcccstctccttttcagcagatgagccagctggagttgcaacaggcagctttagaagggctggccttgccacatgaccttgctgtacaggcagcaaacttctacc

SEQ ID NO: 49059 - DNA, 201 bp, Homo sapiens
tggagtgcagtgttgcaatcttggctcactgcaacctctgcttcccaggttcaagcaattctcctgcctcagcctcctgagtagctgggattacaggcacrtgccatgatgcccagctaatttttgtatttttattagaaacggggtttcaccatattggtaaggttggtctcaaactcctgacctcaagtgatccacctg

SEQ ID NO: 49060 - DNA, 201 bp, Homo sapiens
ttttgtttgtttttgagaccgcgtctcactctgtcacccaggctggagtgcagtgttgcaatcttggctcactgcaacctctgcttcccaggttcaagcarttctcctgcctcagcctcctgagtagctgggattacaggcacgtgccatgatgcccagctaatttttgtatttttattagaaacggggtttcaccatatt

SEQ ID NO: 49061 - DNA, 201 bp, Homo sapiens
  misc_feature (1)...(201): n = A,T,C or G, or insertion/deletion polymorphism (see Tables 1-2)
ttgaggtccacatagcccactgttggggcacagagggagagggacatctgtcagcccaataaatcagtgctttccaagagatggcgttcagcaagaaatgncatgcattaatgaaaatgcctccctgatgcacacataccatcttggtactcactgagactaactttcccgacaggtttcacaccaggaccacagcagcta

SEQ ID NO: 49062 - DNA, 201 bp, Homo sapiens
caccgagcctggccccttccagtacttttatttttatttttttgagatggagtttcactcctgctgctcaggctggagtgcaatggcacgatcttggctcrctgcaacctccgcttcccgggttcaagcaattctcctgcctcagcctcctgagtaggtgggattacaggcatgcaccaccatgcctggctaattttgtat

SEQ ID NO: 49063 - DNA, 201 bp, Homo sapiens
tagagacggtttcactgtgttgctggtgttgaactcctgagctcaggtgatccacccacctaggcctcccaaagtgctgggattataggtgtgagccaccragcctggccccttccagtacttttatttttatttttttgagatggagtttcactcctgctgctcaggctggagtgcaatggcacgatcttggctcgctgc

SEQ ID NO: 49064 - DNA, 201 bp, Homo sapiens
tgcatgctaaatgcaaatgggaaagcagtaactaaatagtagagaaactagagaataccttgaccaaatgatccaaattagcaccatagataaaggacagwtgaacatcatggcctccagaagtgacggtctgtgaaggacacagcacctcttcagttagtattctgccccatggatatttaggctcagtctatcatgaga

SEQ ID NO: 49065 - DNA, 201 bp, Homo sapiens
aagcagttgggaccactgatgacaagaagggttatatcctagttgggcacacatccatatatttccttagtatggatttttctttttttttttttttttttgcacccgacagggcgtcactttgtcgccgaggctggaatgcagtggtgcaatcatggctcactgcagcctggacctcccgggctcaagccatcctcccat

SEQ ID NO: 49066 - DNA, 201 bp, Homo sapiens
ggccggcgggtagccggcgggctggctggcggggaccgagccgccgggccggggaggacggctgcgggcctgcgctagctccagcttgaagcgcccgggcmgggagattcggcctccctcctccctgcggccggccgcccctcagtgagtacggtccccgcccttcctccgaaggaggccgctgggcccgggcctgcgtga

SEQ ID NO: 49067 - DNA, 201 bp, Homo sapiens
  misc_feature (1)...(201): n = A,T,C or G, or insertion/deletion polymorphism (see Tables 1-2)
ctgcgcgcacgggagcgggtttccgctatccccaccgtggcctcctcctcgccgccaccaccttcccaccccccggcccgcgcaggggctggcgtccgggnagcgcgcggcgatgcttctttttcgcccggcaccgctgcagccacctcacatccgggcgcgcggcggggaaggcggcgccggggccagggtgcgtggagg

SEQ ID NO: 49068 - DNA, 201 bp, Homo sapiens
tacatgtgaacggtctttccatccccagatctttgagacctgtgtgatgagagcggaacacgttggtctaagttttctgtgacttgagtatcattctgctrttaactccctaggagtattttatgctttcttgtggtccccaatcaatctgtaagttaagtgagttaagaaagttaaaaccagttttcttttgactctttt

SEQ ID NO: 49069 - DNA, 201 bp, Homo sapiens
  misc_feature (1)...(201): n = A,T,C or G, or insertion/deletion polymorphism (see Tables 1-2)
ggaccacaggcgtgcaccagtacgctcggctaatttttgtattttttatagagatgggaattcgccatgttgcccaggcaaactcctgggcttaagcaatncgcccaccttggcctcccaaagtgttgggattacaggggtgagccactgtgccaggcctcagtcattgactctgacatggcttattgtccctggcttcct

SEQ ID NO: 49070 - DNA, 201 bp, Homo sapiens
  misc_feature (1)...(201): n = A,T,C or G, or insertion/deletion polymorphism (see Tables 1-2)
gacggctgcgggcctgcgctagctccagcttgaagcgcccgggccgggagattcggcctccctcctccctgcggccggccgcccctcagtgagtacggtcnccgcccttcctccgaaggaggccgctgggcccgggcctgcgtgaggggctgcgggttggggtcgcggcccggggaagccaagtttcggagctgaagccgg

SEQ ID NO: 49071 - DNA, 201 bp, Homo sapiens
  misc_feature (1)...(201): n = A,T,C or G, or insertion/deletion polymorphism (see Tables 1-2)
tctctcccagagagaggtcttggctttaaaaggagcaatgctgatggcttagttgagaagcaatttggacagtgctctggttgaggtccacatagcccacngttggggcacagagggagagggacatctgtcagcccaataaatcagtgctttccaagagatggcgttcagcaagaaatggcatgcattaatgaaaatgcc

SEQ ID NO: 49072 - DNA, 201 bp, Homo sapiens
gcaagaccccatctcaaaaaaaaaaaaaaaaaaaagacccccctccactatagaaaatatgaagttcccacgaagggaaccataatcctccccacatcccrttggtattctagctttattaaggcttttttccttttctgcctcccgtagaagggggactgttttattcttgcaagtacagtacctgcacgagaagtctgc

SEQ ID NO: 49073 - DNA, 201 bp, Homo sapiens
ccgaggtgggcagatcacctgaggtcagaagtttgagaccagcctggccaacgtggtgaaaccccatctctactaaaaatacaaaaatagccagacgtggyggtgcatgcctgtaatcccagctacgcaggaggctgagacaggagaatcgcttgaatctgagaggcggaggttgcagtgagccaagatcacgccactgta

SEQ ID NO: 49074 - DNA, 201 bp, Homo sapiens
taaaaccagttttcttttgactcttttagcgaaaccttgaaagccatttgatgtcccctgctgagattccaggccagcctgtccctaagaacatcctgcakgtacttcacaatcttatactgaggccttggagtcttgaacagtagtcttctgaaccagttttgcttagtggtccaactttgggccttagaaaatgatctg

SEQ ID NO: 49075 - DNA, 201 bp, Homo sapiens
ttacatttgtgtcttggtgattgggtgctgactgcaatggtgtggttcatatcttataattagcttctttcttttggtgtgagcaactaaaaatatggaakggggcattcagcagtttacctgatgtttttccacattttattgcagatatgattctaggatttgatattaacacaatttactcgagttgtaagggcagtt

SEQ ID NO: 49076 - DNA, 201 bp, Homo sapiens
caaatgctttcaaatgaagatcagactgaaagatggtagactatcctattttcctttctcgttacatttgtgtcttggtgattgggtgctgactgcaatgstgtggttcatatcttataattagcttctttcttttggtgtgagcaactaaaaatatggaagggggcattcagcagtttacctgatgtttttccacatttt

SEQ ID NO: 49077 - DNA, 201 bp, Homo sapiens
catgttggtcaggctagtctcgaactcccaacctcaggtgatctgcccgccttggcctcccaaagtgctgggatcacaggcgtgagccactgcgcccagcygttccagtacttatttttttgtttctttgagacggagtctcgctctatcaccagagtgcaatggtgcgatcttgattcactagcctctgcctcctgggtt

SEQ ID NO: 49078 - DNA, 201 bp, Homo sapiens
agattcggcctccctcctccctgcggccggccgcccctcagtgagtacggtccccgcccttcctccgaaggaggccgctgggcccgggcctgcgtgagggrctgcgggttggggtcgcggcccggggaagccaagtttcggagctgaagccggtgctcgccctttccttgccatcggcgcccctgacatggccacaggtgc

SEQ ID NO: 49079 - DNA, 201 bp, Homo sapiens
atatggactcaaaaaagtaaggcttcagtcatatttcccctagctaaaaactggagatgcttaaactgcttgtccagataactgcttttgggagagagagraagtcatatttattaaagatcttgcatcagtacatgtcttgttggctactgaatgtttttgaagaggttgacaggactcaaattgtaaattcatttctgg

SEQ ID NO: 49080 - DNA, 201 bp, Homo sapiens
  misc_feature (1)...(201): n = A,T,C or G, or insertion/deletion polymorphism (see Tables 1-2)
actacatggactaaatattaactaaatttagtagtgcattactttgaacatttttctgcaagtgtagatacccagcgtttaagctggaatttgctttgagnggcttttaggtgaagggaatgtaggcttagatttttttaaaattgcggatcagtatactttgtaagttctgtaacagctatgtaattggtacgtttattg

SEQ ID NO: 49081 - DNA, 201 bp, Homo sapiens
ctgatgtgcaagtgtttccctctgcctcttgcctgtaaaaaaacagtttgtaagaaacacactttattcagtaatacaaacgaaaagttttctgttgccargattcacaagaagggagctgagttagtggtcactcactgcccaacaccctaatttcacaagtgaagtgaagttccaacaaagtaggcctcttggaagaaa

SEQ ID NO: 49082 - DNA, 201 bp, Homo sapiens
acttctgaaagattatgtccagcctgtggagacttaagtgtccaacatagaaaatatgtgagaggcttttaggagttgcacagtagggattgtgaaggacrtggtaacatgcggattccaaattagggtttacagaggtgttaaaagtacagatctgagagatttttgcctgtgtttgagaaggcttggggtgggtggtgg

SEQ ID NO: 49083 - DNA, 201 bp, Homo sapiens
gccaggagaattgcctgagcccagtagttcaagaacagcctgggcaacatagtgcccatctctacaaaatataaaaaatttgaccaggcgcggtggctcaygcctataatcccagcactttgagaggccaaggtgggtgatcacttgaggtcaggagtttgagaccagcctggccaacacggtgaaaccccatctctacta

SEQ ID NO: 49084 - DNA, 201 bp, Homo sapiens
gaacttcaggtcagtgactatacttgggccttgacctttgaggcctgaggtcaatcttgtgtagaccaagagtggtcctaaaatagctgaaactcttgattctgtatttgatttgaacgagtgtcacacacagcatcagttctgtgccaggcactgtgctaattattgccgctccctgcccagtgaagcacaggcagccca

SEQ ID NO: 49085 - DNA, 201 bp, Homo sapiens
atcttaaaaataggagtgggaggggtaagtgggacttttcaaatacttttttacgtgctttgtaaaacatttgaaagcacgtgagattcctggtgcagagmctaaaagcagtagttatttatttgaaagattttacgctaaaaacaggaaaattaacttgttgggtgtctcgggcttagcatcacagacaatttgtatttt

SEQ ID NO: 49086 - DNA, 201 bp, Homo sapiens
agaacttcaggtcagtgactatacttgggccttgacctttgaggcctgaggtcaatcttgtgtagaccaagagtggtcctaaaatagctgaaactcttgattctgtatttgatttgaacgagtgtcacacacagcatcagttctgtgccaggcactgtgctaattattgccgctccctgcccagtgaagcacaggcagccc

SEQ ID NO: 49087 - DNA, 201 bp, Homo sapiens
gagaacttcaggtcagtgactatacttgggccttgacctttgaggcctgaggtcaatcttgtgtagaccaagagtggtcctaaaatagctgaaactcttgattctgtatttgatttgaacgagtgtcacacacagcatcagttctgtgccaggcactgtgctaattattgccgctccctgcccagtgaagcacaggcagcc

SEQ ID NO: 49088 - DNA, 201 bp, Homo sapiens
gctcttaaaccagtcagggaggaaggggtgggggtggtgatgggcctcaggtatacagcatcatatcttcctttcactattgaacattacaacgaagaccytgactgaagtagaaatggcttgactagaaattttttaatcttgctttatgtacttttccagagagagtttggagatagtaagcgtgtctttggtgagcgt

SEQ ID NO: 49089 - DNA, 201 bp, Homo sapiens
agagaacttcaggtcagtgactatacttgggccttgacctttgaggcctgaggtcaatcttgtgtagaccaagagtggtcctaaaatagctgaaactcttgattctgtatttgatttgaacgagtgtcacacacagcatcagttctgtgccaggcactgtgctaattattgccgctccctgcccagtgaagcacaggcagc

SEQ ID NO: 49090 - DNA, 201 bp, Homo sapiens
tcgcttgaacccggtaggcagaggttgtggtgagccgagatcatgtcactgcactccagcctgggtgatagagtgagactctgtctcaaaaaaaaaaaaaaggaacctctatttatagcactaacttagagcatatgttgctagctgaacattcagataaatgtgttgcatgtacacatgccaagtccttcagttgagcat

SEQ ID NO: 49091 - DNA, 201 bp, Homo sapiens
gtggaagcagggtagatatgaataataaaaacataaacatggacttattctagttgctaagttatagcaaatttaccaaattgagttttctctctttttttcctgttccctgcttgcctgggaacttaccagttagccaagatgcaagtagcaatagctgtttgaatcattatgtcttataccaaaagaaagcaactgact

SEQ ID NO: 49092 - DNA, 201 bp, Homo sapiens
attccaaactgtcagcattacagaggtcttcgtgttccaccccactgtcccaggccaaccgttacaccaaagaacaagattatcgacctaaagcaactggragaaaaacacccaccttggcatccccagttcctacaacaccttttctccgccctgtccaccaagttccccttgtcccccatgtccctatggttaggcctg

SEQ ID NO: 49093 - DNA, 201 bp, Homo sapiens
tcagaaatagaccctctgtttagaatttttggcaaatgctttctggtttccacaggtggaagctggaacgcagtcccaagtgtcaatggcagaacacagaracctgaatccagttccacctttcctgtgtatcctcttccacttatcttacttccccttcatgttgaaccaacgttaataggtgcaaggtaaggaggactg

SEQ ID NO: 49094 - DNA, 201 bp, Homo sapiens
ggtgattgtctcccccgctagactgagagctcttacaagactgggactgtgtttcattttccttttgtcttccctcagagcttagcatgtgcttttgtgtrtgttaggcctaaatgcttgggaaattgaattggataagggaaaggggatgttaaaacttctaggctggtcttgagtattatatggttttaagacttgaag

SEQ ID NO: 49095 - DNA, 201 bp, Homo sapiens
tacaacttgcacttggaggggagaggtcccaaggcccccgaattagaaatgccaggctcatctctttttgtaacccttcattttaaaatgtaattaataascactctttttgttaaatttttaaatttgggccgatcctaataatcttaaaaataggagtgggaggggtaagtgggacttttcaaatacttttttacgtgc

SEQ ID NO: 49096 - DNA, 201 bp, Homo sapiens
gacttattttcaaggatatgtctgatttttggatagatgtttgctctatcttgtcttttctaaatattgataagaatactgcaaaaaatcaatttggatakttgactgaatttatggtatgatttgaattgaaaaattttttaaatgcttaaatctagtttttaagaaagattggcactatttcataatttctaccaaagc

SEQ ID NO: 49097 - DNA, 201 bp, Homo sapiens
ggactttcagaggccgaggtaggtagattgtttgagttcaggagttcaagaccagactgggcaacctagtgagaccctgtctctacccctaatacaaaaarttagtcgggcatggtggtgcacatctgtggtcccagctatactcgggaggccgaggtgggaggatcacttgagtccaggaggcagaggttgcagtgagcc

SEQ ID NO: 49098 - DNA, 201 bp, Homo sapiens
gcttggcttcggtgagtgtagcagcacacttaaaaatgtgtggttaaatttgacctgagtatttaagacatcggtttgaaagtgttgttttgctagatgcytttggggtttttggcttttattcttacatatttaaatttttgttggctttgttttgagaggcttaatggataatatgagatttttgtaccagttaactct

SEQ ID NO: 49099 - DNA, 201 bp, Homo sapiens
agtgcaggagtcaggagtgagatagattggtagtggcacctccttattttacagatgcagagagaaattgagacctggagagaagggatggatttcatggsagagcctggagtagaatccaggggtcttggttcatcccattagctaactacagaatgtctctaggttgcccttgctatgtatttaaaataaataaaaaca

SEQ ID NO: 49100 - DNA, 201 bp, Homo sapiens
ttaaagcagcacccaataaagcaccactttaacgataaagatcaggcttctggtgagaaaaaattatgtttttcttaagtgaggtgaaatctgaatttcarccattcttgtatcaagtgcaggagtcaggagtgagatagattggtagtggcacctccttattttacagatgcagagagaaattgagacctggagagaagg

SEQ ID NO: 49101 - DNA, 201 bp, Homo sapiens
gaatcaaaatactcatcttcttttgtagtcttcaaaatatagtacatattaccattatctttgtgctatcacacagtgttccctaggataatgtaagaaaytgataggtaacttggaagactttgctattaaattggctttgagatatgtctttgtctcattcttaattaaagcagcacccaataaagcaccactttaacg

SEQ ID NO: 49102 - DNA, 201 bp, Homo sapiens; identical to SEQ ID NO: 38631

SEQ ID NO: 49103 - DNA, 201 bp, Homo sapiens
gatatttatagaccatcggctgttattctaaaggattcaactcctgttacatgaaagaataatagaaaaaaggttggttgacttgtgattgctttttttttaataataaatggctttggtatgtaaataatgattctccttcttttaaaataatatatagcagtggctcacacctgtaatcctagcactttgggaggccaa

SEQ ID NO: 49104 - DNA, 201 bp, Homo sapiens
acattagtaatggctgtcatatttatagctatttcaacctgctggactattttccattccctttaatttttgttgtggtggttgtcagctatgttagttayagcatgtgcacacaatagcagagaaatggtgtttcctatggttgttgtttttgtttggtcagattttggaactcacaggtgttttcaggttcccagtatt

SEQ ID NO: 49105 - DNA, 201 bp, Homo sapiens; identical to SEQ ID NO: 38633

SEQ ID NO: 49106 - DNA, 201 bp, Homo sapiens; identical to SEQ ID NO: 38634

SEQ ID NO: 49107 - DNA, 201 bp, Homo sapiens; identical to SEQ ID NO: 38629

SEQ ID NO: 49108 - DNA, 201 bp, Homo sapiens; identical to SEQ ID NO: 38153

SEQ ID NO: 49109 - DNA, 201 bp, Homo sapiens
caccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactcta

SEQ ID NO: 49110 - DNA, 201 bp, Homo sapiens
attgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattac

SEQ ID NO: 49111 - DNA, 201 bp, Homo sapiens
ctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgtt

SEQ ID NO: 49112 - DNA, 201 bp, Homo sapiens
atataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgat

SEQ ID NO: 49113 - DNA, 201 bp, Homo sapiens
tcaagtccctgacttcctgcctggactccaaagccttcttattgactcctaggaatcaaggtaaggggttaaaatctcataaaacaggattaggactcacmaagtcttctggtgttacagggtgaaagaggctcgtgtgatgtcaccagagggatgtggctaagagctgtgatgtcacctgagggaggcaggatgggttct

SEQ ID NO: 49114 - DNA, 201 bp, Homo sapiens
acccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcgg

SEQ ID NO: 49115 - DNA, 201 bp, Homo sapiens
ttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctataagattgatgatttgccaattttacagatgaaaaaacagacat

SEQ ID NO: 49116 - DNA, 201 bp, Homo sapiens
tcaccacatcctcccgaaaagtgtgtggaggaattcaagtccctgacttcctgcctggactccaaagccttcttattgactcctaggaatcaaggtaaggkgttaaaatctcataaaacaggattaggactcaccaagtcttctggtgttacagggtgaaagaggctcgtgtgatgtcaccagagggatgtggctaagagc

SEQ ID NO: 49117 - DNA, 201 bp, Homo sapiens
gtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgag

SEQ ID NO: 49118 - DNA, 201 bp, Homo sapiens
tgaatgagacaggccagggttaccagcgctttctcctctacagtgagtagggatacaaggcaggaagggttggagggaaacaagggagggcaggagaactmctcactctgggtcctatgacaccctcccaggaagagctaggtgcttccaggggttttgactggcctgaccccaccttgcccttccagatcgctcaccaca

SEQ ID NO: 49119 - DNA, 201 bp, Homo sapiens; identical to SEQ ID NO: 38774

SEQ ID NO: 49120 - DNA, 201 bp, Homo sapiens; identical to SEQ ID NO: 38775

SEQ ID NO: 49121 - DNA, 201 bp, Homo sapiens; identical to SEQ ID NO: 38753

SEQ ID NO: 49122 - DNA, 201 bp, Homo sapiens
agtgcagtggcacagtctcggctcactgcaagctccaaactccgcctcccacgttaacgccattctcctgcctcagcctcccaagtagctaggactacaggtgcccaccaccacgcccggctaattttttttttgtatttttagtagagacggggtttcaccatgttagccaggatggtctcgatctcctgacctcgtgat

SEQ ID NO: 49123 - DNA, 201 bp, Homo sapiens
acgcaggcaagttgatgtaatgcttgcctcactgagttaataggattaaaagatgtgcgcagagcacatagtttagtgccaggcacttttaaagtctcttrgtaaaagtttgatgagtctgaaattgatgaggatagaagttatttgaattgtaggaaaagactgggtgagggagagatgacaattgctgggaggagataa

SEQ ID NO: 49124 - DNA, 201 bp, Homo sapiens
aaggccagtcttgtttgtcccctgcctcctgggttccgccagagagaagcagtggagtaaactgcacagacacagagaaaaccagtcatggaggccaagarctagagagccttgagtggacgtggttaatctcacttggttctcccaagagccctgggaggggggcaatatcatcatcatcatctgacaaatgaagtgacc

SEQ ID NO: 49125 - DNA, 201 bp, Homo sapiens; identical to SEQ ID NO: 38778

SEQ ID NO: 49126 - DNA, 201 bp, Homo sapiens
ccaggcctggggaagaacaagactgctctcctcagacctcactgtagggtgactgagaagagtcatttatttcctgttccaggtcctagacccacctgccygccggatctggaataatgtgactcgctggtttgtcacgtgtgtccggcagccagaattccgagccgtgctaggagaagtggttctatactcaggagccag

SEQ ID NO: 49127 - DNA, 201 bp, Homo sapiens
agcctcccgagtagctgggactacaggcgcccgccaccacgcctggctattttttttttgtatttttagtagagatgaggtttcaccatgttagccaggawggtctcgatctcctgacctcgtgatccgcccagaagtatttttattgtgactatttgagtgaagaaatgggactcagaggtggtgatttgtgagagtggg

SEQ ID NO: 49128 - DNA, 201 bp, Homo sapiens
catcctcttcttctgggtggcccggatggtcatgctgggcctgaagctcacgggcaggctgccctttagagaggtgcggagacagccgagaccctcccatsgcccccagcctcctctcctaccgtcctgtgctgcagcgcagaccccgcgtggctggggcatggggttagctgtgggcaggcctgacccgggggctggtgt

SEQ ID NO: 49129 - DNA, 201 bp, Homo sapiens
ggatggtctcgatctcttgacctcatgatctgctcacctcggcctcccaaagtgctgggattacaggcgtgacccaccgcgcctggcctgtttttttttttgttttttttgtttttttgagacagagtctctctcggtttcccaggctggagtgcagtgatgcgcgcttactgcaacctctgcctcctgagctcaagcgat

SEQ ID NO: 49130 - DNA, 201 bp, Homo sapiens
gggtttcaccctgtcggccaggatggtctcgatctcttgacctcatgatctgctcacctcggcctcccaaagtgctgggattacaggcgtgacccaccgckcctggcctgtttttttttttgttttttttgtttttttgagacagagtctctctcggtttcccaggctggagtgcagtgatgcgcgcttactgcaacctct

SEQ ID NO: 49131 - DNA, 201 bp, Homo sapiens
tgtttgggggagttcaagtgttgggatagtcagggccctggaaaggaaggacttgggcccagcccttcgtgcatttttaaaaagttaaatagccaggcacrgtggctcatgcctgtaatcccagcgctttgggaggctgaggcaggtgaatcataaggtcacgagttcgagactagcctggccaacatagtgaaaccccat

SEQ ID NO: 49132 - DNA, 201 bp, Homo sapiens
gtggcatgatctcggctcaccgcaacctccacctcctaggttcaagcgattctcttgcctcagcctcccaagtagctggcattacaggcacctgccaccgygcctggctaatttttgtatttttagtagagatggggtttcaccatgttggccaggctggtctcaaactcctgacctcaggtgatctgcctgcctcggcct

SEQ ID NO: 49133 - DNA, 201 bp, Homo sapiens; identical to SEQ ID NO: 38793

SEQ ID NO: 49134 - DNA, 201 bp, Homo sapiens; identical to SEQ ID NO: 38794

SEQ ID NO: 49135 - DNA, 201 bp, Homo sapiens
tggtggaagtgggggtgctggtgggaatgggtggggagccaggccagccaggttcacgcctcctctgagctactgacctcccatggtcctcgctcatcttyccaactttgttgtcctgggtgtttgggggtctcttcacttggacctgggtcctcacccaccccctggttccactccagctccaacagacagaagcagagc

SEQ ID NO: 49136 - DNA, 201 bp, Homo sapiens
tgatcgtaaccagttacagatttctttgttccttctccactcccactagccttaaaaaacaaaacagcctggctcagtggctcacacctgtaatcccagaratttgggaggccaaggtgggtggatcacttgagcccaggggtttgagaccagccaacatggtgaaatcccatctctacaacaaaaatacaaaaattagct

SEQ ID NO: 49137 - DNA, 201 bp, Homo sapiens; identical to SEQ ID NO: 38768

SEQ ID NO: 49138 - DNA, 201 bp, Homo sapiens
agaccctcccatcgcccccagcctcctctcctaccgtcctgtgctgcagcgcagaccccgcgtggctggggcatggggttagctgtgggcaggcctgaccygggggctggtgtggggttgaaatccagcctgggccctgctcagtgattcctgtgcccagggcttcatcttcccagaggaaggagtgcttctgattcacat

SEQ ID NO: 49139 - DNA, 201 bp, Homo sapiens
tgccccctaacaggcaccgcatgcgtggggagaccaccctgtggaaccctggctgtgaccatgcaggtattgccacccaggtggtggtggagaagaagctrtggcgtgagcagggactgagccggcaccagctgggccgcgaggcctttctacaggaagtctggaagtggaaggaggagtgagtatgcagcatccctgtgg

SEQ ID NO: 49140 - DNA, 201 bp, Homo sapiens
ccggcctccctgcttctttatttagtccactgactccttgcctgaagcctctgctttctttggtgccaggccccactggcctggctcaccctctggtcctycatgccccctaacaggcaccgcatgcgtggggagaccaccctgtggaaccctggctgtgaccatgcaggtattgccacccaggtggtggtggagaagaag

SEQ ID NO: 49141 - DNA, 201 bp, Homo sapiens
atcagcgtcctaatgtgtcagcagcaaatccccgaggtgtcttcatgatgtgcatcccaccccccaatgtgacaggctccctgcacctgggccatgcactsaccaacgccatccaggactccctgactcgatggtgagcttctatctgcaccttcctctggttccctctgcctagtctggctctctccttttccctgacag

SEQ ID NO: 49142 - DNA, 201 bp, Homo sapiens; identical to SEQ ID NO: 38796

SEQ ID NO: 49143 - DNA, 201 bp, Homo sapiens
gacctcgggcatctaaaataccccatctgaaacctagtatggccgtccaagagggtccccagctggctgagtctgaatttctgcacctctctctaggcccygaggctcctgccctcccaaagacagctgctcagctcaagaaagaggcaaagaaacgggagaagctagagaaattccaacagaagcagaagatccaacagc

SEQ ID NO: 49144 - DNA, 201 bp, Homo sapiens
agccctcatagccgctcgctatggggaggctggggagggtcccggatggggaggagcccacccccgcatctgtctccagccacccccgactagcaggactmcctttcccccaccccgcctgccggccctggagcaggggcccggtgggctctgggtgtggggggccacggctgtggcccagctgctgtggccagcaggcct

SEQ ID NO: 49145 - DNA, 201 bp, Homo sapiens
gccctcatagccgctcgctatggggaggctggggagggtcccggatggggaggagcccacccccgcatctgtctccagccacccccgactagcaggactcsctttcccccaccccgcctgccggccctggagcaggggcccggtgggctctgggtgtggggggccacggctgtggcccagctgctgtggccagcaggcctg

SEQ ID NO: 49146 - DNA, 201 bp, Homo sapiens; identical to SEQ ID NO: 38799

SEQ ID NO: 49147 - DNA, 201 bp, Homo sapiens
ctttttccatattgccttggctcttccttcaaatcttttctccttgactagctttagaatcacaagggttccagctccacccctgcttctttctttttttktttgtttgttttttggagacggagtctcactctgtcacccaggctggagtgcaatggcatgatcccagcttgctgcaacctctgcttcccgggttcaagc

SEQ ID NO: 49148 - DNA, 201 bp, Homo sapiens
gccctttccatatcatggcccttcatgttccctgtcttggctctgggagctccagattcctccagatggcacatgatcaggaccccgtctcccatggagcytgaactcccagtgtcctctgcaccagtacttgtccccagctgattgtcttcctcgccatctgcagcattacaaggcttgttgcctgctcttgtgttccct

SEQ ID NO: 49149 - DNA, 201 bp, Homo sapiens
actttgtcactgtcagtgacccagcggtgccccctggggaggtgagcagagggccagagctagctgctgggacaccctgctggagtggtgggtttactggrtccttggtggggggaggggcagggtgagccagaagcagacacacccccttgggtaatcactgcacctgtggcaggaccctgatgggcggtactgggtgag

SEQ ID NO: 49150 - DNA, 201 bp, Homo sapiens; identical to SEQ ID NO: 12968

SEQ ID NO: 49151 - DNA, 201 bp, Homo sapiens
ccttctcctcgacactcttcctgactaatgtatctctggaatgccccacataggcttttataggagaggaggtcctggaagtgaagacagagtccctgtcsccttcaggatgcctcctgtgggatgtcccagccccctcacttggagctgtccagatcagcatgggcccatcccttgatggctcctcaggtaatggagtct

SEQ ID NO: 49152 - DNA, 201 bp, Homo sapiens
  misc_feature (1)...(201): n = A,T,C or G, or insertion/deletion polymorphism (see Tables 1-2)
gtgaggttcagttgtggggtgggtggtgagctgctgcatattttttattttgtttctctagtgttatggcagtggaggtgggaatttagtccccaggtggnacaagggaagttttttcattttggagctagttactgggagtaagggagggtggggtgggggggagttcaggtttatgtgtgtgcatttcttttttattat

SEQ ID NO: 49153 - DNA, 201 bp, Homo sapiens
ttccgtcaactctgaggcctccctgctctcagccgactcctccagccaggtgagcaccaccttccttccttcctccaggttttccagtgagttcctcctgrcctagaggtatgagagctttcccttcttcagctccttctcctcgacactcttcctgactaatgtatctctggaatgccccacataggcttttataggaga

SEQ ID NO: 49154 - DNA, 201 bp, Homo sapiens
ttcaggttcaaagagaaaggacccatttccccatcttaaccctcttttttatttttttgagatggagttttgctcttcttgcccaggctggagtgcaatgrcgcgatcttggctcactgcaacctttgcctcccaggttcaagcgattctcctgcctcagcctcctgagtatctgggacacagggatgcgccaccatgccc

SEQ ID NO: 49155 - DNA, 201 bp, Homo sapiens
tcctgagtatctgggacacagggatgcgccaccatgcccgactaattttgtatttttagtagagacggggtttctccatgttggtcaggctggtcttgaaytcctgacctcaggtgatctgcccgccttggcctcccaaagtgctgagattacaggcgtgagccaccatgcccagcctcccatcttaaccctcttaaccct

SEQ ID NO: 49156 - DNA, 201 bp, Homo sapiens
accccggagacacttgctggggttctcagagcaagagccagttcagggagttgaacctctccaggggtcctcccagggccctaaggagccccagcccagcsccacagaccagcccagtttcaggtgaggagagagagagagggccccctctcgtttgagggtatgagttggtcttctccccgctttcagtgagggggaccc

SEQ ID NO: 49157 - DNA, 201 bp, Homo sapiens
accagaatgtcaaataattgatggcttgtaagccctaaacttctaaagcttttgttctcgctcttactgtcaacatctcccttgttttttgcccttctttytgccccctgccccacaccaactctcacccaggctcttggggtaggggaggtgctccatgtgaagacagagtccttggcacccccactgtgtctcctggga

SEQ ID NO: 49158 - DNA, 201 bp, Homo sapiens
gaagatgattctagtggcaaagtagagaatgggttgcagaggggcagggccagaggcaagagaaccaaggaagaagcttatgcagttgatcaagtaagatrttcggatgtcatgaagaaagcagacttgagaaagaatgaagtggaatagatgagttgtgacctcctggacattggagagaggtaggagtcaaagaggttt

SEQ ID NO: 49159 - DNA, 201 bp, Homo sapiens
aaccctcatcttcccactgtttcccagaaactacgtagcttcctatatcctcacgcttctacataagtgcctatcctctctccttcaatcccctatttttktttcttctcccttgctgcggtacaggaatccccaccgacatgtccttgggtactttttggactcttcttaagctctgcttcctgataatttctaactccc

SEQ ID NO: 49160 - DNA, 201 bp, Homo sapiens; identical to SEQ ID NO: 12971

SEQ ID NO: 49161 - DNA, 201 bp, Homo sapiens
tcttggcctggcatggaggtcctgagctcctccatttccccaggcttgctgacgagttgagtggctgggtccagcgccaccagagaggccggaggaagatycctcagagggcccaggagagacaggtagggcgggtggctggttcaaggaaggccacttgaagacaagggctaaaggccttgtctggggatttctagtggg

SEQ ID NO: 49162 - DNA, 201 bp, Homo sapiens
gaaggatttggggagtgatgtggaactgcaggggctacagggccaggtggggcccctgctaaggggctcttagcttttatcctgtggataggtgggggccwttggagaattaagcagggaagtaatatgattaggaagatgattctagtggcaaagtagagaatgggttgcagaggggcagggccagaggcaagagaacca

SEQ ID NO: 49163 - DNA, 201 bp, Homo sapiens
gttatctagcagtgaagatttttttgtttgtttgttttttgttttttgcttttttttgagatagggcctccctctgtcacccaaactacagtgtagtgacrgggtcacagctcactgtagccttgacctcctgagctcaggtgatcctcctgcctcagcctcctgagtagttgggaccacagacacatgccaccatgtctg

SEQ ID NO: 49164 - DNA, 201 bp, Homo sapiens
caatagtggtgtgatcttggctcactgtaatctctgcctcctgggttcaagcgattctcctgcctcagcctcctgagtagctgggattacaggcatgctcyaccacgcctggctaattttgtatttttagtagagacagggcttctttcatgttaggctggtcttgaattcccgacctcaggtgatccacccactttggct

SEQ ID NO: 49165 - DNA, 201 bp, Homo sapiens
ctcccaaagtgctgagattacaggcgtgagccaccatgcccagcctcccatcttaaccctcttaacccttcagtgtttacatgatatccagcttttgcctmatcctgcctcccacagatgtccagaccaagatagaacctgtctctccatgttcttccgtcaactctgaggcctccctgctctcagccgactcctccagcc

SEQ ID NO: 49166 - DNA, 201 bp, Homo sapiens
tcttcccacactctaacctttcccacctctgaggagcagtagcagggaatgtttgaaagaagggccccttccctagcgtgtttgagtagagaggaaaaacstctctggctatgtaggtgggtcaggaaggcaggggaatggccatgtgagctttgggtaaatcattccttggggtttgagagcatagtctccttctgccaa

SEQ ID NO: 49167 - DNA, 201 bp, Homo sapiens
ccataaattaaaggcaaggaagtcgtactgtactatacgactacggtcatggccatagttggggagggaggctgcctcctaggggaaaatcaggtaaactrtataagcagtataacaaggttaaactttgaaccctacaaatgtgggctgacaggaagaaagagttacgaaggaaagagtttccaccagcatggagaaagt

SEQ ID NO: 49168 - DNA, 201 bp, Homo sapiens
gaggagcagacgcagctcttccgttgcccggagcaggatgtcccggtattgtgtccccagcctttctctaacccttggtgggtggaaagtgagcccagaayctggacccattcacaggccataactcatctggagtcacccctactttctcatcctttctcacactcctgccctcttgtatcctcccttatttagtttgac

SEQ ID NO: 49169 - DNA, 201 bp, Homo sapiens
tcaatggacatgagacatagttcttgcttttggagagttttgtgagggttataatacatcatggttaaatagttcccttttttttttttttttttttttttgagacagagttttgccctgtcacccaggctagagtgcattggcgtgatctccactcactgcaacctccgtttcctgggtttaagctattgtcctgcctca

SEQ ID NO: 49170 - DNA, 201 bp, Homo sapiens
ccaggggtcctcccagggccctaaggagccccagcccagccccacagaccagcccagtttcaggtgaggagagagagagagggccccctctcgtttgaggrtatgagttggtcttctccccgctttcagtgagggggacccaaagctttctcttgccgtcatcgccttctttgttgtgggagtgctgggcagtctccaagt

SEQ ID NO: 49171 - DNA, 201 bp, Homo sapiens
gtgtgggggttaagcacttatttgaggtgggggtgttcacctctcttctcatcccttttcagaatatagggctcctctcattcctgtgaacccccagtccyggcttctttgtttgaggggattgtgtgaggttcagttgtggggtgggtggtgagctgctgcatattttttattttgtttctctagtgttatggcagtgga

SEQ ID NO: 49172 - DNA, 201 bp, Homo sapiens
cactgttgttgcccaggctggtctcgaactcctgagctcaggcagtctgcccacctcagcctcccaaagtgctaggattacaggcttgagccacctcgccyggcctcctgctccattatttttccagtggagagtagatgatggtgataatgctggtagaaatagtgactattaagtgcttactgagttctaggctctagg

SEQ ID NO: 49173 - DNA, 201 bp, Homo sapiens
aatacaggtgtggtcattctaggatagaaatcactagaggtggggctgggtgtggtggctcatgcttgtaatcccagcactttgggaggccgaggtgggcrgatcacgaggtcaggagattgagaccatcctggctaagatggtgaaaccccgtgtctactaaaaatacaaaaaattagcctgtagtcccagctacttggg

SEQ ID NO: 49174 - DNA, 201 bp, Homo sapiens
gtgttgcttctgtgctgggccctttggtcaatgtcaatttctattttcctatctgtctctggtgccatttacttaactttttcactgaccccctcaacttycctgctgctgggtctggctttttgtctcactctttttatgttggtctctgattcttgtggcttctgttcatgtctgcgcatctctcaatccctgtacccc

SEQ ID NO: 49175 - DNA, 201 bp, Homo sapiens
agtgtcgggacgatgaagcttgtggcatcagtattggcacttcaggtaggactctggtccaatggcccttctccaggaggctccctacctccatccatccrgcctttcctgtggcccccgcctcagcatgcctctttcatcccacagaccagagtgagatcactgagtgaaaaagctgcctctcaagggcccagtgccctc

SEQ ID NO: 49176 - DNA, 201 bp, Homo sapiens
ccggatctggcctctgcctgccccacagggagggtttgcctctcctgctctcctaatctctgctgcctcaacaggtctcaccatgtcccctgcccggggarggctccgctgctacatctgtggcttcaccaaaccctgccaccctgttcccaccgagtgtcgggacgatgaagcttgtggcatcagtattggcacttcagg

SEQ ID NO: 49177 - DNA, 201 bp, Homo sapiens
aggtctcaccatgtcccctgcccggggaaggctccgctgctacatctgtggcttcaccaaaccctgccaccctgttcccaccgagtgtcgggacgatgaarcttgtggcatcagtattggcacttcaggtaggactctggtccaatggcccttctccaggaggctccctacctccatccatccggcctttcctgtggcccc

SEQ ID NO: 49178 - DNA, 201 bp, Homo sapiens
ctctccattttgataaggtgctaagatggaatctggtgatctgtctctcaggtatcattcctttctgctgaagagctactggggtgagaggattctattcwggtctggttcctcttgccacactcttgccagctccaggaggtgaagagtaaattgtaaattgctaaagctggccacagatggctttctcgccagcctcaa

SEQ ID NO: 49179 - DNA, 201 bp, Homo sapiens
tttccccatggtatcttcctcacattccatctatctccagccccatgtttttcttcatagttctgtccctcttgactcacctccaaacggggtggagtgayggaagatatgtagggcgtgggcctttcacaaagcaacagctctacccttacctgccgcccactttccattttccctgcatcactcacctgctctgtgctt

SEQ ID NO: 49180 - DNA, 201 bp, Homo sapiens
cctcacattccatctatctccagccccatgtttttcttcatagttctgtccctcttgactcacctccaaacggggtggagtgatggaagatatgtagggcrtgggcctttcacaaagcaacagctctacccttacctgccgcccactttccattttccctgcatcactcacctgctctgtgcttgctagaccaaacagcca

SEQ ID NO: 49181 - DNA, 201 bp, Homo sapiens
gggattgggatctgggcctgaaatggggcttctgtgttgtccccagtgaaggctcccacaaggacctgatgacctcactgtacagagctgactccccaaayccaggctcccatatgtaccccatcccccatactcacctctttccattttgagtaataaatgtctgagtctgataaaatgtacatttattataagaagacc

SEQ ID NO: 49182 - DNA, 201 bp, Homo sapiens
cctgcccattcccacccctaggtaagatgtgggttttctccaatctgcgctgtggcacaccagaagagccctgtcaggaggccttcaaccaaaccaaccgyaagctgggtctgacatataacaccacctgctgcaacaaggacaactgcaacagcgcaggaccccggcccactccagccctgggccttgtcttccttacct

SEQ ID NO: 49183 - DNA, 201 bp, Homo sapiens
gaatggggtgtgagtggggtcagcacttctctgtgttctaggtaagtttgttcctgtcaattgggaaccccctcaaccacttccattccccaaatacctgygctgctaccgatgcctcttggagaccaaggagttagggtgccttctgggatctgacatctgcctcaccccagctggcagcagctgcatcactctccacaa

SEQ ID NO: 49184 - DNA, 201 bp, Homo sapiens
ggcagcactctgccctccccacatcattgctggtggacttgtctcccctactagactgtgccctgtgagggtggagactttgtgcagggttgtatccccarcatctgatgcagtgattcaataaacatctgtccaattaataggaaagacagttccttttctcattcccctattgctggtcccctgccctcaagcaggatg

SEQ ID NO: 49185 - DNA, 201 bp, Homo sapiens
tccttagtgtgactgcagcaaactttggtgtaaaattccaccagtttccagccaccttcctgacttctatctgggcttggccaggacttctagtccctcayaccagccctccttgcctccctccagccactggaccccagccttggctcttcctcttggttgacgcccttcagcacacttactgctactctgtacccccag

SEQ ID NO: 49186 - DNA, 201 bp, Homo sapiens
actctcccaaacggaaactctctcagcctcctaagctgcaccccaagtcttgttcccataatcccataagacattgctccaatcctgtcttttttttttttgctgctctgtcacccaggctggagtgcagtggcgcaatcttggctcactgcaacctccacctccccagttcaagcaattcttgtgcctcagtctcccaag

SEQ ID NO: 49187 - DNA, 201 bp, Homo sapiens
ctcccgggttcaagcgattctcatgcctcagcctcccgaataactgggattacaggcataagccaccaagcccagctaatttttgtatatttagtagagayggggtttcaccatgttggccaggctggtctcgaactcctgacctcaggtacctgcccgccttggcctcccaaagtgctgggattacaggcgtgagccacc

SEQ ID NO: 49188 - DNA, 201 bp, Homo sapiens
aacgcaatctcgagccgctcccccaacaaaccgtggccctctcccgaccgggtcatctacagccccgcccctcgtttgcctggctccattcccctaacctkggcgttctgtcctcaggccccgccttctttgtttcgtcactcggttgcttaccctcaggtatcccttaactctaggtaggagcactcagaagggacaccg

SEQ ID NO: 49189 - DNA, 201 bp, Homo sapiens
tctcctgtcatgggcccagcactctcccaaacggaaactctctcagcctcctaagctgcaccccaagtcttgttcccataatcccataagacattgctccratcctgtcttttttttttttgctgctctgtcacccaggctggagtgcagtggcgcaatcttggctcactgcaacctccacctccccagttcaagcaattc

SEQ ID NO: 49190 - DNA, 201 bp, Homo sapiens
cataagacattgctccaatcctgtcttttttttttttgctgctctgtcacccaggctggagtgcagtggcgcaatcttggctcactgcaacctccacctcyccagttcaagcaattcttgtgcctcagtctcccaagcagctgggattaaaggtgcacgccaccacgcccagctaattttttgtatttttagtagagatgg

SEQ ID NO: 49191 - DNA, 201 bp, Homo sapiens
caggcgtgagccaccgtgcccagcctctcttcccttttcttcagagccacactctgtctccacttccactaaccttctctcctcaatctgtagctgaatakcttctaccctatcaaggtgcgcagctttgacggggaccctccagatctccaggtgcccttgcctgtcctcaagctgtctgcttccgcatctgtctgcagt

SEQ ID NO: 49192 - DNA, 201 bp, Homo sapiens
tgtccttggcgtggcgagtcccaggagaaccagtgagacaagactggtggttctcaaagactcatatgtcccttacaggcgcctgcccccgcaaccgattsgaccactccctagatttggtgagactaattccaccccattttctttctcctacatgcccactccccacccctcaattcctgagtctgagcccttgctggg

SEQ ID NO: 49193 - DNA, 201 bp, Homo sapiens
ggcaggaccagaaccttcgcaaaagaaagagctagacctagagctctggtcctggcttggcgaagaatgggagaggtcaaaggtgggagcgaggccgctgrctggtgagtagagccccaccagagcagatgagctggaagtgcagcagagttagagcctgggctggactgtcggtggggtagagtctaagttgtttccggt

SEQ ID NO: 49194 - DNA, 201 bp, Homo sapiens
cgagcgggacccccaccgtgcctcccctccagcctttcgtcggccgcctacgctccctggactctggtatccggcggctggagctcctcttgagcgcgggrgactcgggcacttttttctgcaagggccgccacgaggacgagagccgtacagtgcttcacgtgctgggggacaggacctattgcaaggcccccgggccta

SEQ ID NO: 49195 - DNA, 201 bp, Homo sapiens
tgtccaaaggacgccgaccgatcctgtgggcctcttcgagcgggacccccaccgtgcctcccctccagcctttcgtcggccgcctacgctccctggactcyggtatccggcggctggagctcctcttgagcgcgggggactcgggcacttttttctgcaagggccgccacgaggacgagagccgtacagtgcttcacgtgc

SEQ ID NO: 49196 - DNA, 201 bp, Homo sapiens
cccccaccgtgcctcccctccagcctttcgtcggccgcctacgctccctggactctggtatccggcggctggagctcctcttgagcgcgggggactcgggmacttttttctgcaagggccgccacgaggacgagagccgtacagtgcttcacgtgctgggggacaggacctattgcaaggcccccgggcctacccatggta

SEQ ID NO: 49197 - DNA, 201 bp, Homo sapiens
actccgacacatacccggaggagggaagagggccttggctgggggttcttgagcgggactgctggctgtccctcgtcaaacccctgacctcagcatccctmcccgccacgcctttcccccagggtccgtgtatccccagctcctgatcccgctgctgggcgctgggttggtgctcggactgggagctttgggcctggtctg

SEQ ID NO: 49198 - DNA, 201 bp, Homo sapiens
tcaattcctgagtctgagcccttgctgggagcagacacgttggtcaccttctctccatccttcagctctgtcccccccacatagctccacttgtgaaaacygagccccagaggccagtaaaggaggaagagcccaagattccaggggacctggaccaggaaccggtaagggcatggggatgggaaggggatagccagaatc

SEQ ID NO: 49199 - DNA, 201 bp, Homo sapiens; identical to SEQ ID NO: 38884

SEQ ID NO: 49200 - DNA, 201 bp, Homo sapiens
cacatgcttctccccagtggaggagtgcagggttgtgcccatggtggcagacatgcagtcagtgacgatcttcaaagcctctcctttgtctctgctgtgcytcgcaagacggcttaaaccctgtctggaataatgctgatgaaatgcatttgtattccctgagcccaagcaacccagatgaaggaatgatagagtttgttc

SEQ ID NO: 49201 - DNA, 201 bp, Homo sapiens
ctccccagtggaggagtgcagggttgtgcccatggtggcagacatgcagtcagtgacgatcttcaaagcctctcctttgtctctgctgtgcctcgcaagayggcttaaaccctgtctggaataatgctgatgaaatgcatttgtattccctgagcccaagcaacccagatgaaggaatgatagagtttgttccctaatgct

SEQ ID NO: 49202 - DNA, 201 bp, Homo sapiens
ttctccactaccttgaggctgtgagtgccttcaggtcggggagcatctaggtacccccaggccctagctcaggccctgcacacagcaagtgctaattggcrtggagggaaaacatgcacagtcagcagaggcagagcaatttcagcgcagcctcagtgcagagcttgctgtagccccagtgtcacactgaccgggtattat

SEQ ID NO: 49203 - DNA, 201 bp, Homo sapiens
tgagctgtgatcattccactgcattccagcctgggtgccactgcattccagcctgggtgacagaacagctgggcatggtgcgggtgcctgtaatcccagcwgcggtgggaggatcgtttgagttcaggagctctgggctgcagtgcgctatgccagttgggtgtctacactaagtttggcattagtatggtgacttcctgg

SEQ ID NO: 49204 - DNA, 201 bp, Homo sapiens
cccagctgcggtgggaggatcgtttgagttcaggagctctgggctgcagtgcgctatgccagttgggtgtctacactaagtttggcattagtatggtgacytcctgggagctagagctcatcaggttgcctaaaggaggggtgaagcaaccaaggtcagagacgaagcaggtcaaaactcctgtgctgatcagtagtgggc

SEQ ID NO: 49205 - DNA, 201 bp, Homo sapiens
gagctcttgccagtgcccacacttcctaccattgagtggacacagttgagctggcgagtcacctgttgttggacatttaggtagttgctgaattttttttwatgttataaataactctgccgtgacaaataggaatctgacgggaggcttttgggggaagggcactcttgccagagggaatggtgtaagcaaagcaacaga

SEQ ID NO: 49206 - DNA, 201 bp, Homo sapiens; identical to SEQ ID NO: 38859

SEQ ID NO: 49207 - DNA, 201 bp, Homo sapiens
tgtgaccaaccggcgctgcaggtgcggggcgggccgggctgggggcgcttcccgaacgcaggttgtggggccttgggggattgtttccctggctcgaggtkcgggatgcagagtgcgcgggggcgcagcgagggctcgaggtcctggcggggtcagagcgcgcgggctttgcagatttgggggagggagtgcggggtcggg

SEQ ID NO: 49208 - DNA, 201 bp, Homo sapiens; identical to SEQ ID NO: 38864

SEQ ID NO: 49209 - DNA, 201 bp, Homo sapiens
ggctgagagctcaagtaagggctgctgtttttgactcctgttgaccgaggagccttactcttgatttaggcatagagctggaatctacctgggccagccascgcaaggacagaccctgctcatagccaaagatagcttccctgagctagggagagggtgtagggtgagcaatgcacaaagattctatgctgctctgtgttg

SEQ ID NO: 49210 - DNA, 201 bp, Homo sapiens
caataactcataatctgatttggaggtttgccctttacaggggcagattttctgctcagttcaacaatgaaatgaagaggaactccctctttctacagctyacttctatcagaggcccaggtgcctcagagccacattgagttgctttttctgggatgaggaagtagggttaaactccccagtttcctgagggaggctcct

SEQ ID NO: 49211 - DNA, 201 bp, Homo sapiens; identical to SEQ ID NO: 38866

SEQ ID NO: 49212 - DNA, 201 bp, Homo sapiens; identical to SEQ ID NO: 38869

SEQ ID NO: 49213 - DNA, 201 bp, Homo sapiens
tgcagaagaggccatctcccatgagtggtgagcagggtccaggggagggtgggagaggccagggtccccctcacacccagcagccccatctttgaggcctrgaaggggtgcaggtacctagagctcagggcagcccagaggctctgcctggtagtccctggatgccacatagaagggctgagcagagtctccacaaaggct

SEQ ID NO: 49214 - DNA, 201 bp, Homo sapiens
tcatatgtaggctgttgcacttcaggcagccaagctgagtagctggatgtctagccagaaaagcaggggtaggatctaagcctgcctatcctctagccccycctggtatggtctctgcccctagcttggcctgagccaggttggggtctcccaaaagcagcccctatgttgtggggaagtggagagtagtacagctaagcc

SEQ ID NO: 49215 - DNA, 201 bp, Homo sapiens
ctttccttcctgccgcgattcccaactttgctcaaagtcgctggactctaagctgtcggagggaccgctggacagacctgggaactgacagagggcctggwgggaaacaggccaaagacccacaggcagagttgacacggaaccccaaagcaaggaggagggctcgggcccgagaccgttcacctccccttatccctgttc

SEQ ID NO: 49216 - DNA, 201 bp, Homo sapiens; identical to SEQ ID NO: 14953

SEQ ID NO: 49217 - DNA, 201 bp, Homo sapiens
tcacggattcagagtgagtgctccaccctttgagtctggcacagtccgtgtccggctagggactatttggggcctcagtaactattttgggtgcttcctarggcaggtgccaagcccagtttagctcgggtggcagtgtataggaggtctttcaaggtgaccttggcagctgagcccctgggtggacatggggcagcaagg

SEQ ID NO: 49218 - DNA, 201 bp, Homo sapiens
ccgggccagaggccccacctgcaacgaggtatgggaccctcctgcagatccctggttagatggggccaggtgtctgtcttatctccagggcttagcctctkatagaggctctgaccctgccttgttcccaccccagttcacagggcagtgccactgccgtgccggctttggagggcggacttgttctgagtgccaagagct

SEQ ID NO: 49219 - DNA, 201 bp, Homo sapiens; identical to SEQ ID NO: 14971

SEQ ID NO: 49220 - DNA, 201 bp, Homo sapiens
aggctgggattgggcacggggagagaaagctgagcctggggcaggaactagagagctggactgctgtctaaattgcaggaaattggggttaggggcttggratagaacttgaccagggatccagggtgggatcccttaggcttaggagaggactggcagtgagctagttgagatagggtgagtgaccctgtatctcttttt

SEQ ID NO: 49221 - DNA, 201 bp, Homo sapiens; identical to SEQ ID NO: 14956

SEQ ID NO: 49222 - DNA, 201 bp, Homo sapiens
tgctgggtggtgatggggtctggaggtctgtttctggcccccagcaactcctttcgtgcagcctggccactggggcctgagccacgacctgctcggctgcygcccctgtgactgcgacgtgggtggtgctttggatccccagtaagtgttgtaaagggggcctgggaagggatggggaaagatcctgagcagaagagaagg

SEQ ID NO: 49223 - DNA, 201 bp, Homo sapiens
gcttgggaggctgaggtgggaggatatcttgaacccaggaggtcaaggctgcagtgagccaaggtcacgcactgtactccatccatcctgggcaacagagmccgcatctcaaataaacaaataaataaataaatcagaaaataaaaagaaaaaagatgagggattgaagaacaatttttgggatgggataaaagaacccaa

SEQ ID NO: 49224 - DNA, 201 bp, Homo sapiens; identical to SEQ ID NO: 14958

SEQ ID NO: 49225 - DNA, 201 bp, Homo sapiens
cactgccgccagcacatggttgggcgacgctgtgagcaggtgcaacctggctacttccggcccttcctggaccacctaatttgggaggctgaggacacccragggcaggtgtggggcctccccctaagcagagggctggatgtgggtggacacgtctatgactggagaggtggggttatgggcagtaccttgttgagggga

SEQ ID NO: 49226 - DNA, 201 bp, Homo sapiens
tcagaccctggagttcctggtggcctctgtgccgaaggctatggactatgacctgctgctgcgcttagagccccaggttagaccctgttatctaatctggrgctgaacctctgggtgtgggagcatctcctccatcatcccgttttcccaggtccctgagcaatgggcagagttggaactgattgtgcagcgtccagggcc

SEQ ID NO: 49227 - DNA, 201 bp, Homo sapiens; identical to SEQ ID NO: 14950

SEQ ID NO: 49228 - DNA, 201 bp, Homo sapiens; identical to SEQ ID NO: 14973

SEQ ID NO: 49229 - DNA, 201 bp, Homo sapiens
ggggctggctgtggcagaagaggcaaagcctcacctgagcctccatccctggctgcattatctcccaggtgctcgatgtggtggagcgcctggtgaccccyggggaaactccatcctggactggctcaggcttcgtgcggctacaggaaggtcagaccctggagttcctggtggcctctgtgccgaaggctatggactatg

SEQ ID NO: 49230 - DNA, 201 bp, Homo sapiens
agagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccat

SEQ ID NO: 49231 - DNA, 201 bp, Homo sapiens; identical to SEQ ID NO: 14952

SEQ ID NO: 49232 - DNA, 201 bp, Homo sapiens
gactttatttctcttttcccatcccccttattttaggtacgtacccggttcccgccagaacccaatggaatcctgcatattggacatgccaaagccatcartttcaactttggctatgccaaggtaagcatgtgtctagggacctggcaagcaagatgaccacttgctgttcccatgagtggataccatatccctgccttg

SEQ ID NO: 49233 - DNA, 201 bp, Homo sapiens
ttggcagcagctcctatagtcaggcccctggggtcagaggctttggctgcagcctggtccttaggcttattctggtcctggcaggtgagaactacaagacyccaggctatgtggtcactccacacaccatgaatctactaaagcagcacctggagattactggtgggcaggtgtgtggggatgtggccatgtgagcttgtg

SEQ ID NO: 49234 - DNA, 201 bp, Homo sapiens
gcaggttgggtagatacattgggggttgagtgtggcagtttgtgattgtagctgtgactgatgctgaactttcctgccaggtgggagtgactgtggcacaraccacaatggagccacatcttctagaagcctgtgtgcgtgatgtgctgaatgacacagccccacgagccatggctgtgctggagtcactacgggtcatca

SEQ ID NO: 49235 - DNA, 201 bp, Homo sapiens; identical to SEQ ID NO: 14949

SEQ ID NO: 49236 - DNA, 201 bp, Homo sapiens
  misc_feature (1)...(201): n = A,T,C or G, or insertion/deletion polymorphism (see Tables 1-2)
tggactaggcaaagcctagaagggctggtggttagtgggcctctccttgggccatggcctgcccactgggtgtttgtggctggctgctcatactttgtttnattttgccccaggctacacaccttacaaagtcacatatgcgtctgactattttgaccagctatatgcgtgggctgtggagctcatccgcaggtaaggcca

SEQ ID NO: 49237 - DNA, 201 bp, Homo sapiens
atgactcatacctgtctcctgtctcctgctatagtccttggacatccaggtgcccaacttcccagctgatgagaccaaaggcttccatcaggttccctttrcacccattgtcttcattgagaggactgacttcaaggaggtaaattgtgggggtggagggtcccgtttgctgctgagtctggtactgggaacctttcatct

SEQ ID NO: 49238 - DNA, 201 bp, Homo sapiens; identical to SEQ ID NO: 14951

SEQ ID NO: 49239 - DNA, 201 bp, Homo sapiens
acgtcattgagctgcagcatgttgtcaaggtgagagccagctgcagccttcctactgcagtgcctgctggggccaagatgtgagtatagcctgcagtcctsgttgtggttcccgggtctaattgctgctcccctccccccacttccagggccccagtggttgtgtagagagtctggaggtgacctgcagacgggcagatgc

SEQ ID NO: 49240 - DNA, 201 bp, Homo sapiens
tcccatggaggagtcactgctgctctttgaggtggggtcctagaggagcatctgggtttgggtgggccaaggtgctgagaatgagatgctcctgtgcttasagacagcctgagtccttgttcccctcaggcaatgcgcaagggcaagttttcagagggcgaggccacactacggatgaagctggtgatggaggatggcaag

SEQ ID NO: 49241 - DNA, 201 bp, Homo sapiens
gccatggcctgcccactgggtgtttgtggctggctgctcatactttgtttcattttgccccaggctacacaccttacaaagtcacatatgcgtctgactaytttgaccagctatatgcgtgggctgtggagctcatccgcaggtaaggccagggccatgacgtagagccaggcagactgactaggtcacagccatgctggg

SEQ ID NO: 49242 - DNA, 201 bp, Homo sapiens
tggtgtttcttttgttccctttgcccagagactggcatgagaggcctcagatgtctggctctagatatcttgtctctggaattgagggaataggggtctaytcagttctgttctggctgtaggatatggtaaatgtatctagaggacaagttttccttgttttgttccccacaggcgagactgctgaccagaccctgtctc

SEQ ID NO: 49243 - DNA, 201 bp, Homo sapiens
gcgaggccgctactcaggtgcgagcccctctgcccccggcctggtttgcagaccatgctgcaacgcagcgcggggcggggtccagatcccgacctgccccrtttgtcccgccctttcctctcactgagcgcggggcttctctcttgacccctctgacctcaggctcagcagaccctgggttccaccattgacaaagctacc

SEQ ID NO: 49244 - DNA, 201 bp, Homo sapiens
gaggccatcaacaacttctgtgcccgggtatagcccagcaggttgggtagatacattgggggttgagtgtggcagtttgtgattgtagctgtgactgatgstgaactttcctgccaggtgggagtgactgtggcacaaaccacaatggagccacatcttctagaagcctgtgtgcgtgatgtgctgaatgacacagcccca

SEQ ID NO: 49245 - DNA, 201 bp, Homo sapiens; identical to SEQ ID NO: 14967

SEQ ID NO: 49246 - DNA, 201 bp, Homo sapiens
  misc_feature (1)...(201): n = A,T,C or G, or insertion/deletion polymorphism (see Tables 1-2)
agctagcagacccacatgagaagagatgggatgggctaggtaggttttttcagtcagtgctggtagataggccaggaagccttgggttggtgggtaggatnagtcaggggctccttgaaagaggatactcctgcctctgcctgattctggtctctgctcaggtcctccaccttctgggccccaagttggaggctgatctgg

SEQ ID NO: 49247 - DNA, 201 bp, Homo sapiens
gaagaaaaggcaggaaggcagacaaactcagcgtaacttttacagaaaaaaccaatgtataatccctctctctctctcatatataaatataaataaataaatatatatatatatatatgcacacacatacacgaaggcctaagaactctgagagtaagtcctagtccaagttctgaaggcctatgaaccagaagtgcaatg

SEQ ID NO: 49248 - DNA, 201 bp, Homo sapiens
taggtttacaatatacataacaataccatatattgtttgtggttaatacatatttggtaaatgtaaaaatctttatgggaatgataaacagcaaattcaaracagtgtgtacctctggaaggatggaagaaaatggaactgagatcgagtaaacaataccaaaagttttcttaagaagatggtattcattatatcattcac

SEQ ID NO: 49249 - DNA, 201 bp, Homo sapiens
aagaaaaggcaggaaggcagacaaactcagcgtaacttttacagaaaaaaccaatgtataatccctctctctctctcatatataaatataaataaataaatatatatatatatatatgcacacacatacacgaaggcctaagaactctgagagtaagtcctagtccaagttctgaaggcctatgaaccagaagtgcaatgt

SEQ ID NO: 49250 - DNA, 201 bp, Homo sapiens
aggcagacaaactcagcgtaacttttacagaaaaaaccaatgtataatccctctctctctctcatatataaatataaataaataaatatatatatatatayatgcacacacatacacgaaggcctaagaactctgagagtaagtcctagtccaagttctgaaggcctatgaaccagaagtgcaatgtccaagggcaagaga

SEQ ID NO: 49251 - DNA, 201 bp, Homo sapiens
ttctaagaggctgctcaatattgggaaatatattgaggagttattccatggaaatacaatgctttccacctactactgtagttcaataacgtttccacctraaaaaatatcatccatgcccagatgaaaaggaagagtatctgtcactgctacatagttccttaatttgactgtaacacatttgtttcaagtctttggatt

SEQ ID NO: 49252 - DNA, 201 bp, Homo sapiens
ctctgaaagcaaagatgcagcagcggtagtgtctttacttatcaaaaccatcaagtcctttttcttgggtatatatttaatcagtaagttaattagtggcmtaaaaaagtagcatcagggtcttttcccaagccagtgagcaagagcattatttcataaagaatagggatttatcatttcaggaaaaaaaaaaacattcaa

SEQ ID NO: 49253 - DNA, 201 bp, Homo sapiens
tacatttcttagaagcaaaatattacaaatgcattaccagtcctagatacaaagctttgttttacagcaattagtgtaccctaatttttagtgtgccccawgtttggtgtgtcccaatttttggtattgtggcagaaggtgaaggctctgaaagcaaagatgcagcagcggtagtgtctttacttatcaaaaccatcaagt

SEQ ID NO: 49254 - DNA, 201 bp, Homo sapiens
atgaaaagcttttaaagagctttgggtttagttggagttgtctttttgagagctcatcattcatttatagatggtgccaaagctaaccttacatttcttaraagcaaaatattacaaatgcattaccagtcctagatacaaagctttgttttacagcaattagtgtaccctaatttttagtgtgccccaagtttggtgtgt

SEQ ID NO: 49255 - DNA, 201 bp, Homo sapiens
gccactctcctagccgtgtccgacatgggtccagttcagggcactcctccagccacggccaacacgggtctggcacaagttgttcttccagctgtggccaytatgagtctggctcaggccaggcttctggttttgggcaacacgagtctggctcaggacagggctatagtcagcatggttctgcctcaggtcacttctcta

SEQ ID NO: 49256 - DNA, 201 bp, Homo sapiens
ctggatctggccactctcctagccgtgtccgacatgggtccagttcagggcactcctccagccacggccaacacgggtctggcacaagttgttcttccagstgtggccattatgagtctggctcaggccaggcttctggttttgggcaacacgagtctggctcaggacagggctatagtcagcatggttctgcctcaggtc

SEQ ID NO: 49257 - DNA, 201 bp, Homo sapiens
ggccgacaagggtctggatctggccactctcctagccgtgtccgacatgggtccagttcagggcactcctccagccacggccaacacgggtctggcacaasttgttcttccagctgtggccattatgagtctggctcaggccaggcttctggttttgggcaacacgagtctggctcaggacagggctatagtcagcatggt

SEQ ID NO: 49258 - DNA, 201 bp, Homo sapiens
agtcctctggttacagtcagcatggatctggctcaagtcactcctccggctacagaaaacacggctctaggtcaggacagtcatctaggagtgaacaacayggatctagctcaggtttgtcttccagctatggtcagcatgggtcgggctcccatcaatcttcgggccacggccgacaagggtctggatctggccactctc

SEQ ID NO: 49259 - DNA, 201 bp, Homo sapiens
gtgctaccttagccatggcactacactgacctattttgtttgggaagacatttacaagggtgtttaatacagcattgtttgtaatagtgaatttggaaaayggataaagtatactatattcttatattggaaagctacagtgcacctagaagaaaataactattatatatacacatagattttaaaaacataataactttg

SEQ ID NO: 49260 - DNA, 201 bp, Homo sapiens
acactgacctattttgtttgggaagacatttacaagggtgtttaatacagcattgtttgtaatagtgaatttggaaaatggataaagtatactatattctyatattggaaagctacagtgcacctagaagaaaataactattatatatacacatagattttaaaaacataataactttgagtgaaaatcaagttgcaaact

SEQ ID NO: 49261 - DNA, 201 bp, Homo sapiens
ctgaaaaaatagagacaggataaggaacagatttctttgaaatgtgcataccctgtctaccagcagttctactcctactcgtatacctcagaggagtttgyatgcagacatacttcattttattgtgctccactttattgtgcttcacagactgtgtgttgtacaaattgaaggtttgaggcaaccctgtctggcaagtcc

SEQ ID NO: 49262 - DNA, 201 bp, Homo sapiens
taggaagattcatcatgcctggcaggagggggtcactgttattgcaacctttaacccaatccttttctcttctgcccactttggggagtgatctgggtgayttggtttgttcttttttgagatgcttaccaattgctgacaacaatcacaatgcattataacatgattgaggcccacaatttcaaaagtgtgatgatggaa

SEQ ID NO: 49263 - DNA, 201 bp, Homo sapiens
gcatggggagtagtggaggtgaagctaagagccaagtggagaaggaagtgagaggaagaaagtgaatttagcccactcaccatcattatctctgacatctytcaaaggaagtagagtgggaaacaaaaggagattaaagcaagtttgtctagataggaagattcatcatgcctggcaggagggggtcactgttattgcaac

SEQ ID NO: 49264 - DNA, 201 bp, Homo sapiens
gctatgtaccaatgtctcattacttaccccttttttgccttcacaataactctttgatgcagagatccttaaacttctcctcagtatgcaaattgaggttrtaaatccaaggacacacagctcacctatgatgtagttcagatttgaactcaagtgtgactatgaactcattctcaatctactagcccacagtgacttcac

SEQ ID NO: 49265 - DNA, 201 bp, Homo sapiens
tcacttgggccctggagttggaagctgcagtgagccatggttgcaccactgcactttagcctgggcaacagtgagacccaaaaaaaaaaactatatatatwtttttttctcatatatatatatatatatatatatatatatatatatattagagaaagatactgatggaataaataaaaggatacatgtatgaatgagctc

SEQ ID NO: 49266 - DNA, 201 bp, Homo sapiens
ttggaagctgcagtgagccatggttgcaccactgcactttagcctgggcaacagtgagacccaaaaaaaaaaactatatatatatttttttctcatatatatatatatatatatatatatatatatatatattagagaaagatactgatggaataaataaaaggatacatgtatgaatgagctctggattcccagcatttg

SEQ ID NO: 49267 - DNA, 201 bp, Homo sapiens
tggaagctgcagtgagccatggttgcaccactgcactttagcctgggcaacagtgagacccaaaaaaaaaaactatatatatatttttttctcatatatatatatatatatatatatatatatatatatattagagaaagatactgatggaataaataaaaggatacatgtatgaatgagctctggattcccagcatttga

SEQ ID NO: 49268 - DNA, 201 bp, Homo sapiens
agcttcctatgcatatgcttcaacatatgcaaatcaataaaagtgatacatcacatgaacagaatcaagaacaagagccatgatcatttcaatagatgctwaaaaaagtactcgataaaattcaacactgcttcatgataaaaactctcaataactgggtatagaagaaacaataaaggccatatatgacaaatccacagc

SEQ ID NO: 49269 - DNA, 201 bp, Homo sapiens
ggaagctgcagtgagccatggttgcaccactgcactttagcctgggcaacagtgagacccaaaaaaaaaaactatatatatatttttttctcatatatatatatatatatatatatatatatatatatattagagaaagatactgatggaataaataaaaggatacatgtatgaatgagctctggattcccagcatttgaa

SEQ ID NO: 49270 - DNA, 201 bp, Homo sapiens
gaagctgcagtgagccatggttgcaccactgcactttagcctgggcaacagtgagacccaaaaaaaaaaactatatatatatttttttctcatatatatatatatatatatatatatatatatatatattagagaaagatactgatggaataaataaaaggatacatgtatgaatgagctctggattcccagcatttgaag

SEQ ID NO: 49271 - DNA, 201 bp, Homo sapiens
ttcaccctatgaatatgtccaagagcagaggtgctacttttatcagtgaataataaacataaatgcaatttactcaagtagcaatttaagaaataggaaastcatctatgaattcatcatgaaagacaagcaatccatcatgaaattcgttctaaaagtgaatcaatgcatttctgtctctttctttagagcctaaaactg

SEQ ID NO: 49272 - DNA, 201 bp, Homo sapiens
aagctgcagtgagccatggttgcaccactgcactttagcctgggcaacagtgagacccaaaaaaaaaaactatatatatatttttttctcatatatatatwtatatatatatatatatatatatatattagagaaagatactgatggaataaataaaaggatacatgtatgaatgagctctggattcccagcatttgaagc

SEQ ID NO: 49273 - DNA, 201 bp, Homo sapiens
caggatttctttgccctttggcttctagttaggttcagccaatggggaccctggtagcagataaaaggaaaggaaaagtgtgaggtgggatactgagtgtrtcctcagcctcttccacaacctgtatctgtttctcagaagtcacaatgcctttctagtaaagtccttcaactacccattggaatgtgtggtgtgtttcct

SEQ ID NO: 49274 - DNA, 201 bp, Homo sapiens
tatatatatatatatatatatatatatatattagagaaagatactgatggaataaataaaaggatacatgtatgaatgagctctggattcccagcatttgragcattttggagttctcggaagagaaaatggaggatattaagggagaaagaaacaactcaataggcagaccagtactgaagcagaatatattccagggtg

SEQ ID NO: 49275 - DNA, 201 bp, Homo sapiens
ggtcagtcttccagccacggtcagcatggctctggctcaagtcagtcttctcgctatggccaacagggctctggatctggccagtctcctagtcgcggccracatgggtccgattttgggcactcttccagctacggccaacatgggtctggctccggttggtcttcaagcaatggcccacatgggtctgtctcaggccag

SEQ ID NO: 49276 - DNA, 201 bp, Homo sapiens
ggggcttcagcagagggcaagtagatgaaaggaaagaaaaaactaagatgactttgggtgtggattggaagggctgtttggactgaatataaagaatataygcaatagggtattttggtgaatttttaagcagaaggttactgataatagtaaaaagtggtgcttctcaaatataattattatgttaacccttccaatgaa

SEQ ID NO: 49277 - DNA, 201 bp, Homo sapiens
tatggtcagcatgggtctggctcccgtcagtcttcgggccacggccgacaagggtctggatctggccagtcccctagccgcggccgacatgggtccggttyggggcactcctccagccacggccaacatgggtctggctcaggtcgttcttccagccgtggcccatatgagtctcgctcgggtcactcttctgtctttggt

SEQ ID NO: 49278 - DNA, 201 bp, Homo sapiens
gtggcccatatgagtctggctccggtcactcttctggcttaggtcaccaagagtctcgctcaggacagtcctctggctacggtcaacacggatctagctcrggtcattcctctacccatgggcaacatggttctacatcaggacagtcatcgagctgtggccaacatggagctacctcaggtcagtcttccagccacggtc

SEQ ID NO: 49279 - DNA, 201 bp, Homo sapiens
agggcagtcctctggttacagtcagcatggatctggctcaggtcactcctctggctacggacaacacggctctaggtcaggacagtcatctaggggtgaamgacacagatctagctcaggttcgtcttccagctatggtcagcatgggtctggttcccgtcagtctttgggccacggccgacaagggtctggatctcgcca

SEQ ID NO: 49280 - DNA, 201 bp, Homo sapiens
gccacggccgacaagggtctggatctcgccagtctcctagccacgtccgacatgggtccggttcggggcactcctccagccacggccaacacgggtctggmtcaagttactcttacagccgtggccattatgagtctggctcaggccagacttctggctttgggcaacatgagtctggctcaggacagtcctctggctata

SEQ ID NO: 49281 - DNA, 201 bp, Homo sapiens
tggcagtcctctggttacactcagcatggatctggctcaggtcactcctccagctacgaacaacacggctctaggtcaggacagtcatctaggggtgaacracacggatctagctcaggttcatcttccagctatggtcagcatgggtctggctcccgtcagtctttgggccacggccaacatgggtctggatctggccag

SEQ ID NO: 49282 - DNA, 201 bp, Homo sapiens
ccatatccagaagactgagttttcaaagagacttttctggccaacataactcctactcaggtcagtcttccagctatggtgagcaaaactccgactctcaycagtcttcaggccgcggccaatgtgggtctgggtcagggcagtctcccaactatggccaacacggctctggctccggacagtcttccagcaatgacacac

SEQ ID NO: 49283 - DNA, 201 bp, Homo sapiens
aagaatcatgctaaatctactctgtgctgtataaatggaacagcaaagcctggatgatggcacatctgtttacagcatggtttactaactatttaagcccmctgttgagacctactactcagaaaaaagagattcctttcaaaatattactgctcattgacaatgcacctggtcatccaacagctcggataaaaatgtaca

SEQ ID NO: 49284 - DNA, 201 bp, Homo sapiens
gcaggagagaatgattcctattccagaaacgtcagaggaagtcttaaacctgggactgaatccatatccagaagactgagttttcaaagagacttttctgrccaacataactcctactcaggtcagtcttccagctatggtgagcaaaactccgactctcatcagtcttcaggccgcggccaatgtgggtctgggtcaggg

SEQ ID NO: 49285 - DNA, 201 bp, Homo sapiens
catggacacataccccagaacttaaaagtcaaataaaaaacaataaaaacaaattgattaaaaatttttttttaaaaagtagagcctaaagacttaattgytacaatctcatgataaaacttaaacagatgagaagttggttatgaatgagcaaagaaagtgatttcttgagatggaatctacacctggtgaagatgctat

SEQ ID NO: 49286 - DNA, 201 bp, Homo sapiens
gatactgtggatatcatcttgcaaagtctggatcgagaccataacaagaaagtggattttactgagtatcttctgatgatattcaagctggttcaggctcrtaataaaatcattggcaaagattactgccaagtttcagggtcaaagctgagagatgacactcaccagcaccaagaggaacaagaagaaactgaaaaagag

SEQ ID NO: 49287 - DNA, 201 bp, Homo sapiens
atattcagatatcagatgtcagatattcagtgtgtcagctatgaatctcataatcttccccactaacctttttccttcatctttttgcccaaagcaaaaayctggtgtcattttttattgtctctctctcagcagacaccactaccttctaacctccatctaactcatcaataatctctcaaaacaacccatttctcttca

SEQ ID NO: 49288 - DNA, 201 bp, Homo sapiens
cggaagtgaccttactaaacaacaaacaaaacccacaggttaaataatgtcctatctaagtgactaattcctacaaacccagacagtcctcagaaaaactstgaagtagatttctgagttcaggaaattggcatttactcctgaatcacaaaagaatgtgtccaccaccttaaaactgtcaggtctagatttgatagctta

SEQ ID NO: 49289 - DNA, 201 bp, Homo sapiens
tttgagataaggtcaaaagcagatccgtgatggtttccatagcataactaacggaagtgaccttactaaacaacaaacaaaacccacaggttaaataatgycctatctaagtgactaattcctacaaacccagacagtcctcagaaaaactgtgaagtagatttctgagttcaggaaattggcatttactcctgaatcaca

SEQ ID NO: 49290 - DNA, 201 bp, Homo sapiens
ttgtcacatatgtcaaacatcctagaggattgtccttacttggtgagagagaacagggtttggtaaaagtttgagataaggtcaaaagcagatccgtgatkgtttccatagcataactaacggaagtgaccttactaaacaacaaacaaaacccacaggttaaataatgtcctatctaagtgactaattcctacaaaccca

SEQ ID NO: 49291 - DNA, 201 bp, Homo sapiens
gggccttgttagcagtagcaacttttcaggtaaaataaaactaacaatatggaatatactaggagctatgtaccaatgtctcattacttaccccttttttrccttcacaataactctttgatgcagagatccttaaacttctcctcagtatgcaaattgaggttataaatccaaggacacacagctcacctatgatgtagt

SEQ ID NO: 49292 - DNA, 201 bp, Homo sapiens
aaagcaagtttgtctagataggaagattcatcatgcctggcaggagggggtcactgttattgcaacctttaacccaatccttttctcttctgcccactttggggagtgatctgggtgacttggtttgttcttttttgagatgcttaccaattgctgacaacaatcacaatgcattataacatgattgaggcccacaatttc

SEQ ID NO: 49293 - DNA, 201 bp, Homo sapiens
ttagattctcataggaacacgaaccctattgtgaactacaccaggagggatctaggttgcatgtgccttatgagaatctaatgcctgataatccaagatgraacagtttcatccctaaaccatcccacccccactgttctcccatccatggaatagttgacttccatgaaaccagtccctgctgccaaaaaggttgggaat

SEQ ID NO: 49294 - DNA, 201 bp, Homo sapiens
actgttattgcaacctttaacccaatccttttctcttctgcccactttggggagtgatctgggtgacttggtttgttcttttttgagatgcttaccaattyctgacaacaatcacaatgcattataacatgattgaggcccacaatttcaaaagtgtgatgatggaatcctagatagatatgaaagaaggcaggaagggga

SEQ ID NO: 49295 - DNA, 201 bp, Homo sapiens
gagaaggttataggtatgggaggaaaaaccagaaacccttacagcaggggtccccaacccctgggctacagactagtactagtctgtggcctgttagtaaycaggccacacagcagtaggtgagtggcagcccaccgtgcattactgcctgaacttcgcctcctgtcagatcagcagctgcattagattctcataggaaca

SEQ ID NO: 49296 - DNA, 201 bp, Homo sapiens
gtgaagcaggaggcttagaaagatctgaaaagggaaaggtctgaaaattccagctgaggggtctggtaaaagaaaccacctaggtatgatgaaagggattkccaggcaatattcagagtgtgggcaaggttaatataataaatgtgtagaaataagctaaggcaccatgtatgtgatatttgccatcttaacagcctggca

SEQ ID NO: 49297 - DNA, 201 bp, Homo sapiens
tctgtaagacagaaatactaatatttcacctaaggatttgaacagttaatgtctaaatatctataaatcacattgacatgtacacagaagatactaatttaaaaaaaaagctctgtggcaagtaacaatgaaagcaagcaaaaacaagtttttactattttttataacaatgctacactctaaaaatatatcgacaagcaa

SEQ ID NO: 49298 - DNA, 201 bp, Homo sapiens
gagtgaagcaggaggcttagaaagatctgaaaagggaaaggtctgaaaattccagctgaggggtctggtaaaagaaaccacctaggtatgatgaaagggaytgccaggcaatattcagagtgtgggcaaggttaatataataaatgtgtagaaataagctaaggcaccatgtatgtgatatttgccatcttaacagcctgg

SEQ ID NO: 49299 - DNA, 201 bp, Homo sapiens
actgggaacattacattatgtgctatatacttgacatatatttatttattgtttaatttcattctcatagcaaccctgtggttataaatgttattttactyaagagcaaactgagactttaaaaggtcaagtatattatattagtaaagtcaggttttatacctaaatctgtctaactccaaaacatatgtgtttgctaac

SEQ ID NO: 49300 - DNA, 201 bp, Homo sapiens
aggggaagagcatttctggcaaaaattcttttaaaaagaaggatgcctggaggttttggagaatagcaaggaagctaatatggcttcagcagggtaccacragggagagagtggtgaaagatgaggccagaaaggaaacagaggtctgatcagtttgctactcattacattcatactacaatgcctcactctcccttctct

SEQ ID NO: 49301 - DNA, 201 bp, Homo sapiens
actaaaaggaagatggggagggagtgaagcaggaggcttagaaagatctgaaaagggaaaggtctgaaaattccagctgaggggtctggtaaaagaaaccrcctaggtatgatgaaagggattgccaggcaatattcagagtgtgggcaaggttaatataataaatgtgtagaaataagctaaggcaccatgtatgtgata

SEQ ID NO: 49302 - DNA, 201 bp, Homo sapiens
gacctagttgattccttttagaaacaaagttaggagaattcacatccgttggcccctatggagacaacaaaactgactccttgcccaaccaccattatgamtaagcatataaagtcgcaccattggagaggaaaaacaaaaatctttacaaccctgagataagctaaaaatgaggaagaagattctacctagtcttccaaa

SEQ ID NO: 49303 - DNA, 201 bp, Homo sapiens
gatagcatattggcagaagagtagataatacagatcaatataacaataaatagcccagaaacagatcctaatatatatatttttaattaatttgtgaactstctgctacatagttaatatatatagtgtacttagaaaagtgtctggtccacagtaatcatctaataaatattagtggctatctttattactacttgttgt

SEQ ID NO: 49304 - DNA, 201 bp, Homo sapiens
cctgtcttacaggaaatgctaaagggagttcttcaatctgaaagaaatggatgctaatgtacaagaaaacatctaaagtaattaaactcactgctaaaagaaaaaaaaaaaaaacagacaaattcagaatactctaaatgtcttgactgcccatggcaggatccttgattttctcctgtgctggatcacacgtgtccatga

SEQ ID NO: 49305 - DNA, 201 bp, Homo sapiens
caattccttcaatagcctgtctcagccctcttcctctacccctcctgttctctcagactccctgactctgtgtgctctaccctagaaacaaagggctcctkagcatcaccacccaccttggtttgtccttacctacaaattcttgccagaacactccagatgttgaagacttaaaattgtgacaaatcagccatgcaatat

SEQ ID NO: 49306 - DNA, 201 bp, Homo sapiens
gaaacagtgttaaaaaatagtgttaaatagtgttaaagaaatagtgttaaagaatagtgttaaaccctctgcagagggttttttattgttgtttttgttaktgttatttttcttttctttgctatgaagttaagtcattatcagcttaagataacctgtaataacataagatgtttttgtaggccttatggtaatcaaaaa

SEQ ID NO: 49307 - DNA, 201 bp, Homo sapiens
atacccaattccttcaatagcctgtctcagccctcttcctctacccctcctgttctctcagactccctgactctgtgtgctctaccctagaaacaaagggytcctgagcatcaccacccaccttggtttgtccttacctacaaattcttgccagaacactccagatgttgaagacttaaaattgtgacaaatcagccatgc

SEQ ID NO: 49308 - DNA, 201 bp, Homo sapiens
actcaaaaacctagaacatggcacataccatagaaaagcttttctcctgaaacctatcatctccaagtggaaaaaccactaaccaaacccatgatggaggaatcttcatgtccaactctgttactatggagcacacactctaaaaaaaacaagaaactgttttgaaagtgacttttgtgataatctagtcctactcttaat

SEQ ID NO: 49309 - DNA, 201 bp, Homo sapiens
cttcagttccttgaatgctccataacttctctcacctctagccctttgttcatataattccctctgcctagaacaatcttttccccttctctttctcttcytacttcttcatttggctaatcctaatccatccttcaaaaggcatcatttcctctcattaacctttctaggacccccaatgtttcctctctgatgtactct

SEQ ID NO: 49310 - DNA, 201 bp, Homo sapiens
ggattatattcctaatttcatcactctcttgctacatggcttgaacaagtcattcaactctgaattggttcttgattacaacagaatgaatttaatcatgactgactaattctgaacaattattataaataattagaactatttatgtgtttaaacaagaaataagaatagtaaggggttggtctctctttttcctccctt

SEQ ID NO: 49311 - DNA, 201 bp, Homo sapiens
gattatattcctaatttcatcactctcttgctacatggcttgaacaagtcattcaactctgaattggttcttgattacaacagaatgaatttaatcatgactgactaattctgaacaattattataaataattagaactatttatgtgtttaaacaagaaataagaatagtaaggggttggtctctctttttcctcccttt

SEQ ID NO: 49312 - DNA, 201 bp, Homo sapiens
gttcctcaaagcactaaaaatagatctaccatatgatccagcaatcccactcctgggtgtttatccaaaagaaagaaaatcaatttattgaagagatatckgcatacccacatttattgtggcactgttcacaatagtcacaatatggaatcaatctaagtgtccatcagaggatgaatggataaagaaaagtggtatata

SEQ ID NO: 49313 - DNA, 201 bp, Homo sapiens
ttatattcctaatttcatcactctcttgctacatggcttgaacaagtcattcaactctgaattggttcttgattacaacagaatgaatttaatcatgactgactaattctgaacaattattataaataattagaactatttatgtgtttaaacaagaaataagaatagtaaggggttggtctctctttttcctccctttag

SEQ ID NO: 49314 - DNA, 201 bp, Homo sapiens
taaaggcctacatcaaaaaaagtagaaagactccaaataaacaatctaatgaggcacttcaagaaactagaaaagcaagaacaaaccaaacccaaaattastagaaaaaaagaaataataaaaattagagcagaaagaaatggcattgagactatatatataatcaatgaaaaaatgacattgagcatatataatatacat

SEQ ID NO: 49315 - DNA, 201 bp, Homo sapiens
agaaaaaagattacaacttgctgaaggttcattagcattttttagcattgaagtattttcaatgaaggaatgtatacttttttagacataatgctattgarcactcaatagagactactctacagtgtaaacacacatttatacacactgggaaaccaaacaattcatgtaactcactttattgcaatattctctctaatg

SEQ ID NO: 49316 - DNA, 201 bp, Homo sapiens
ttcactgtcccagtggtgccaagaggaagcaagttggcacagaaatccaatccatgtcccagttaataatccatgcatacctagttaaaagctacatccayctcagtacttttatctttgccccaggcactttctatttgccaagctgtgagctcagaggactaggtccataaaaagaggaagtctttcttattcacacaa

SEQ ID NO: 49317 - DNA, 201 bp, Homo sapiens
ctatatatataatcaatgaaaaaatgacattgagcatatataatatacataatcaatgaaaaatgacattgaaactatatatataactatatatataactatatatataactatatatataactatatatataactatatatatataactatatataactatatataactatatatataactatatatataactatatata

SEQ ID NO: 49318 - DNA, 201 bp, Homo sapiens
cccaaagagagggaatttcactaagtaatggaagataaaatgcattttataaagttattataaatactcttctgccagatagcatattggcagaagagtasataatacagatcaatataacaataaatagcccagaaacagatcctaatatatatatttttaattaatttgtgaactgtctgctacatagttaatatatat

SEQ ID NO: 49319 - DNA, 201 bp, Homo sapiens
agttaaaagctacatccacctcagtacttttatctttgccccaggcactttctatttgccaagctgtgagctcagaggactaggtccataaaaagaggaastctttcttattcacacaaaggtgccatatagtctagctgtggtgctaccttagccatggcactacactgacctattttgtttgggaagacatttacaagg

SEQ ID NO: 49320 - DNA, 201 bp, Homo sapiens
cccttacctatcattaataacttttaatataaatgaattaatttctaaaattaaatgacatagagtggctgaatggatttttttaaatgaccaaactatargctgtctataagaaacttagttcacctataaagatatgcacagactgaaagtgaggagatggaaaaaggtactttatgcaaatggaaatcaaaagagagc

SEQ ID NO: 49321 - DNA, 201 bp, Homo sapiens
caaaaactttttagtgttagttttaatttttaacaaaaaaagttttttaaaaaaatttaaaacagaaaaaagcctacagaataatgatgtaaagaaaaaartatttgtgttcagctatacaatgtgttcgtgctttaagctaggtgttaattaagagagtcaaaaagtttaaaaatgtaaaagtctataaacctaaaaatt

SEQ ID NO: 49322 - DNA, 201 bp, Homo sapiens
attatattcctaatttcatcactctcttgctacatggcttgaacaagtcattcaactctgaattggttcttgattacaacagaatgaatttaatcatgactgactaattctgaacaattattataaataattagaactatttatgtgtttaaacaagaaataagaatagtaaggggttggtctctctttttcctcccttta

SEQ ID NO: 49323 - DNA, 201 bp, Homo sapiens
actcttccagctacggccaacatgggtctggctccggttggtcttccagcagtggccgacatgggtctggctcaggtcagtcttctggatttggtcaccaygagtctagctcatggcagtcctctggttacactcagcatggatctggctcaggtcactcctccagctacgaacaacacggctctaggtcaggacagtcat

SEQ ID NO: 49324 - DNA, 201 bp, Homo sapiens
accatggataccatgctaacaagcacgcatttcttcctaaggttatatggtgtttgaaatgaaagctatggtgatgaatggccaataaggggtctggtaarttgaggtacttaatgagttaaaggatggcctggagccattatccatttcaaaaggtaataacaataccaaagatgacactttggctggaataccatttaa

SEQ ID NO: 49325 - DNA, 201 bp, Homo sapiens
gctggaaaaaagccacagcccagatcatgaggaaccatggataccatgctaacaagcacgcatttcttcctaaggttatatggtgtttgaaatgaaagctrtggtgatgaatggccaataaggggtctggtaaattgaggtacttaatgagttaaaggatggcctggagccattatccatttcaaaaggtaataacaatac

SEQ ID NO: 49326 - DNA, 201 bp, Homo sapiens
gaggagcaaagagtggtaaactacagcctgcagttcatagctagcttgtcatccatttttgtgtagcctacaggataaaaaggttttctacatttgtaagyggttgaaaaaatatatgatatgtgaaattatatgacattcaaagatcagtattgataaataagttttactgaaacatagccatgctcatttgtttacata

SEQ ID NO: 49327 - DNA, 201 bp, Homo sapiens
aaaggaatgtaattttcattcttctgccaacacacagagaaaggcactcaaaaacctagaacatggcacataccatagaaaagcttttctcctgaaacctrtcatctccaagtggaaaaaccactaaccaaacccatgatggaggaatcttcatgtccaactctgttactatggagcacacactctaaaaaaaacaagaaa

SEQ ID NO: 49328 - DNA, 201 bp, Homo sapiens
ataacaagaattcccaggagacaaaaaagagaagggcctagaaagcatatttaaggaaataatggctgaaagtttccaaaatctggagaaagatgatgccrtccaagtacaagatgctcagaagtcactaatcaaattcaacccaaagaggaaatccccaagacatatcataattaaattaccaaaaattaaagacaaagc

SEQ ID NO: 49329 - DNA, 201 bp, Homo sapiens
ggaaatggatgatagaaataaattagatgataattcatcattatttcccctcatctcataccttctctttctcatttattgctttgctttttatttatttmtttactttgagatggggtcttgctctattgcccaggccggagtgcagtggcaaaatctcagctcactgcagcctccacctcccaggttcaagcaattctc

SEQ ID NO: 49330 - DNA, 201 bp, Homo sapiens
agggtgtttaatacagcattgtttgtaatagtgaatttggaaaatggataaagtatactatattcttatattggaaagctacagtgcacctagaagaaaayaactattatatatacacatagattttaaaaacataataactttgagtgaaaatcaagttgcaaactattaatatgtacactacattacataaattttaaa

SEQ ID NO: 49331 - DNA, 201 bp, Homo sapiens
atgcagcacagtaacatggcacatgtatacatatgtaacaaacctgcacgttgtgcacatggaccctaaaacttaaagtataataataataaaattttttwaaaaaagaaaatttggctttccataattttcccaaaaggagaaagcattcatcagcaagattaatataaatacccagtgtttctgataatgcatttctga

SEQ ID NO: 49332 - DNA, 201 bp, Homo sapiens
gataaacaaattgtggtatggctatacaatggaattctatttagcaaggaaaaaaagaataaactactgatacatgtaacacagatgaatctcaaaaacaygttgatcaaaagaagccatccacaaaagagtacatatttatgattccatctatatgaaacttactaaaacaaacctaatctataaaaatagaaagtagat

SEQ ID NO: 49333 - DNA, 201 bp, Homo sapiens
tgtctgtaaatccaaagacaatctcaaaaagtaaaaaggacaaaccacagagtccaagaacatttttgaaatgcctataaacaacagatgatcaatagccrgattatgtaaataacttataaaaattaaaaatttaaaaaacagcaaaacttagaaaattcaccaaaatttataaaaattaaaaattaaaaagaaacagca

SEQ ID NO: 49334 - DNA, 201 bp, Homo sapiens
gttaagcaacacgattgtgtactttactatagggcctagcaattccactcccaagcgaaatgacaacgtatgtctacattgaagatttttacatgaatgtytatagcagctttaataatagccccaaacttgaaacaatccaaatgtccacgaacagatgactggataaacaaattgtggtatggctatacaatggaattc

SEQ ID NO: 49335 - DNA, 201 bp, Homo sapiens
attaaaattgacaataaataaatgttgattaaatactaagacttttctcatctgtgcttcatttcacttcttacatacagatggtcatcctagaaaccaamccaaacagcgatttcccaatattctatttttcacaatgaagaatagataaagcattcttaaaactcaataagacaaactacttcattttaaaatgatcaa

SEQ ID NO: 49336 - DNA, 201 bp, Homo sapiens
aagtctataaacctaaaaatttacagtaagctaaagttaatttttactggaggaagaaattcttttataaatttagtgtaattcaagtgtatagtgtttayacactctacagtagtatacagtaatgtcctaggccttcccattcactcaccactcactgactgacacctacagcaacttctagtcctacatgctctattc

SEQ ID NO: 49337 - DNA, 201 bp, Homo sapiens
agacaaactacttcattttaaaatgatcaaaattccatcacactggtattggcaatgatttttttgatatgacaccaaaatcacacacaataatgtggagstgtcagctccatacattttattgtccctgaagcccttagagggagacaacatatggaggtagaaggcgatatttgtcttggtttaacaaaaactttttag

SEQ ID NO: 49338 - DNA, 201 bp, Homo sapiens
ctgtaacacatttgtttcaagtctttggattcaaacaaccggattgtattaaaattgacaataaataaatgttgattaaatactaagacttttctcatctstgcttcatttcacttcttacatacagatggtcatcctagaaaccaacccaaacagcgatttcccaatattctatttttcacaatgaagaatagataaagc

SEQ ID NO: 49339 - DNA, 201 bp, Homo sapiens
aaacttagttcacctataaagatatgcacagactgaaagtgaggagatggaaaaaggtactttatgcaaatggaaatcaaaagagagcaggagtagctatscttagataaaagaggttttaattaagaatgattttagacatgaagtccttgcccatgcctatgtcctgaatggtattgcctaggttttcttctagggttt

SEQ ID NO: 49340 - DNA, 201 bp, Homo sapiens
ttcaataacgtttccacctgaaaaaatatcatccatgcccagatgaaaaggaagagtatctgtcactgctacatagttccttaatttgactgtaacacatytgtttcaagtctttggattcaaacaaccggattgtattaaaattgacaataaataaatgttgattaaatactaagacttttctcatctgtgcttcatttc

SEQ ID NO: 49341 - DNA, 201 bp, Homo sapiens
atgacattgagcatatataatatacataatcaatgaaaaatgacattgaaactatatatataactatatatataactatatatataactatatatataacwatatatataactatatatatataactatatataactatatataactatatatataactatatatataactatatataactatatataactatatatatat

SEQ ID NO: 49342 - DNA, 201 bp, Homo sapiens
actgttattgcaacctttaacccaatccttttctcttctgcccactttggggagtgatctgggtgacttggtttgttcttttttgagatgcttaccaattmctgacaacaatcacaatgcattataacatgattgaggcccacaatttcaaaagtgtgatgatggaatcctagatagatatgaaagaaggcaggaagggga

SEQ ID NO: 49343 - DNA, 201 bp, Homo sapiens
aaaatgacattgaaactatatatataactatatatataactatatatataactatatatataactatatatataactatatatatataactatatataacwatatataactatatatataactatatatataactatatataactatatataactatatatatataatcaatgaaatgataatttggttttttggaaagat

SEQ ID NO: 49344 - DNA, 201 bp, Homo sapiens
tataactatatatataactatatatataactatatatataactatatatatataactatatataactatatataactatatatataactatatatataacwatatataactatatataactatatatatataatcaatgaaatgataatttggttttttggaaagataaacaaaatcaagaagccattagttagactaaga

SEQ ID NO: 49345 - DNA, 201 bp, Homo sapiens
aatgaagccttgagccctttcctataaattgctaactctctaatgtaaacaacttcatccctgacttttgcaacactgacacctacaagtatgataatgayatggaggaaattttttcatccacatgaatagactaactgtaatcttggtagcctgactcctcattctttttgaatcacttcccaatcttaacaaagaagg

SEQ ID NO: 49346 - DNA, 201 bp, Homo sapiens
cacactaaaatgctatatagcagttaaaattcatgagctacaggtacgtatatatcaacatggacaaattccaaaagtgtaatgccaagtgaaaaggttgyaaaacaagtatacatggtgtgataccatttatataggtttacaatatacataacaataccatatattgtttgtggttaatacatatttggtaaatgtaaa

SEQ ID NO: 49347 - DNA, 201 bp, Homo sapiens
tagtccactggtgtatctggtccagcatgtcctagtcttttaaataaatgtctcaccacatgagtgcctaatgatattcatcagctgaaccacacaacacrccctctgccacagacttcaaacacaccaaggggccttctagaaaatttggctttctcaaaattgacaaatgggatctaattaaactaaagagcttctgca

SEQ ID NO: 49348 - DNA, 201 bp, Homo sapiens
taataaaagttagaggtgataaataccctgattgccctaatttgattattacacatcatatgcatgtatcaaaatatcacatgtatctaataaatatgtayaattattaggtatcaattttaaaaattaaaaaaaagctaagtgtatctaaaacagagccttgcaaaattccaacaccataaaaagaagcaagcaaaaaca

SEQ ID NO: 49349 - DNA, 201 bp, Homo sapiens
tgtatctggtccagcatgtcctagtcttttaaataaatgtctcaccacatgagtgcctaatgatattcatcagctgaaccacacaacacaccctctgccayagacttcaaacacaccaaggggccttctagaaaatttggctttctcaaaattgacaaatgggatctaattaaactaaagagcttctgcacagcaaaagaa

SEQ ID NO: 49350 - DNA, 201 bp, Homo sapiens
tggaaattaaacaacatgctcctcaacaatgaataggtcaatgaagaaaataagaaatttgttgaggaaaaaatgaataaacaatgtatgaaaatctatasaatatggcaaaagtagttctaagaggtaaagtcacagcaataaaggcctacatcaaaaaaagtagaaagactccaaataaacaatctaatgaggcacttc

SEQ ID NO: 49351 - DNA, 201 bp, Homo sapiens
catggaaattaaacaacatgctcctcaacaatgaataggtcaatgaagaaaataagaaatttgttgaggaaaaaatgaataaacaatgtatgaaaatctakagaatatggcaaaagtagttctaagaggtaaagtcacagcaataaaggcctacatcaaaaaaagtagaaagactccaaataaacaatctaatgaggcact

SEQ ID NO: 49352 - DNA, 201 bp, Homo sapiens
ttaagaatgattttagacatgaagtccttgcccatgcctatgtcctgaatggtattgcctaggttttcttctagggtttctatggttttagttctaacacktaagtctttattccatcttaaattaatttttgtataaggtgtaaggaagggatccggtttcagctttctacatatggctagccagttttcccagcaccat

SEQ ID NO: 49353 - DNA, 201 bp, Homo sapiens
gtaatcaaaaagcaaaaacctatcataaatacactacaaataaatagcacaaaatcaaaacatactatgggaaaaaaccacttaactacaaaggtaaacamgaagagagagaaaactctgccaaacaaccagaaaataagtaacaaaatgccaatagtaaacccttacctatcattaataacttttaatataaatgaatta

SEQ ID NO: 49354 - DNA, 201 bp, Homo sapiens
cagcagacctgtcttacaggaaatgctaaagggagttcttcaatctgaaagaaatggatgctaatgtacaagaaaacatctaaagtaattaaactcactgytaaaagaaaaaaaaaaaaaacagacaaattcagaatactctaaatgtcttgactgcccatggcaggatccttgattttctcctgtgctggatcacacgtg

SEQ ID NO: 49355 - DNA, 201 bp, Homo sapiens
cacattgattttgtatcctgagactttgctgaagttgcttatcagcttaaggagattttgggctgagatgatggggttttctagatatataatcatgtcayctgcaaacagggacaatttgacttcttcttttcctaattgaatgccctttatttccttctcctgcctgattgccctggccagaactcccaacactatgtt

SEQ ID NO: 49356 - DNA, 201 bp, Homo sapiens
cccctgccacacacacatgcacgcacgcacgcacgcatgcacatcgaaaggcaaatgttctggatttgatttccaacaatcaaggtccttatatctcagcttttttttttttttttttggtaccatttctaacacttgaagtgtttgtgagaatcgcttccagtcactcttctccatttgtccactttaatggaccaggtc

SEQ ID NO: 49357 - DNA, 201 bp, Homo sapiens
aaaatgtatgtatatatatatatatatacacacatatatttatatataaaattatataaattatatataattatataaaacacatatatataaattttttwaaaaagtttttgtattagtctgttctcacattgctataaagaactacctaagactgggtaatttataaagaaaagaggtttaattgactcacggttccac

SEQ ID NO: 49358 - DNA, 201 bp, Homo sapiens
atgttctggatttgatttccaacaatcaaggtccttatatctcagcttttttttttttttttttggtaccatttctaacacttgaagtgtttgtgagaatsgcttccagtcactcttctccatttgtccactttaatggaccaggtctgcatgctgaatgtttcaggtagtaggaactaagggatagagactatgaatacc

SEQ ID NO: 49359 - DNA, 201 bp, Homo sapiens
attatataaattatatataattatataaaacacatatatataaattttttaaaaaagtttttgtattagtctgttctcacattgctataaagaactacctragactgggtaatttataaagaaaagaggtttaattgactcacggttccacaggttgtacagggagcctggctagagagacctcaggaaacttacaatcac

SEQ ID NO: 49360 - DNA, 201 bp, Homo sapiens
acagagcgagactccatctcaaaaataaataaataaataaataaataagattaaacttagtgagaaaagcatgtcaaaagcagagagaggccaaaagctargccttttgtgccagttagccaagtttgtgaatgcaaatgaaaaattcttaaagaaaattaaaagtgctactcctgtgaacacatgaatgataagaaagca

SEQ ID NO: 49361 - DNA, 201 bp, Homo sapiens
tgagaatcgcttccagtcactcttctccatttgtccactttaatggaccaggtctgcatgctgaatgtttcaggtagtaggaactaagggatagagactakgaataccaagccagtaagagcatcaaacatcaagataagaacacacagcctaagtaacacagtgagacctcatctctacaaaaaaatgtaaaaattagac

SEQ ID NO: 49362 - DNA, 201 bp, Homo sapiens
catgcatatctttcagtagcttcttgagaagacacaggaaataactttcttgagtcttgattgatagtttgactaggtttacaaattatgtactatcaaattttttttttttttgagacggagtctcgctgtgtcacccaggctggagtgcagtggcacaatctcagctcaatgccacctccacggtgagttccagtgatt

SEQ ID NO: 49363 - DNA, 201 bp, Homo sapiens
caaattccagttcaactagagagattcagcttcctggtgttcccagggggatctagctctgaaaagagcccctttcttctgtcaggacatcctcagcaaaraaggctgcaggtctgagctgagcagcctggagagtggggattccaactccccccgagagtgtctacctgcctggcttcctccctgaggaaagtcactgtc

SEQ ID NO: 49364 - DNA, 201 bp, Homo sapiens
agctgtaatcttcttagccctgaagagatgcctcttactgtcagcatctctgcttcttttcacacagcaggatacgtcttggagccttacccaagtctgcrctacttctagccagcatttgggaggcaaatggactagctgaggctggagtaaagcagttcctcaccaagttgagggaatcttgttgcatacggccctcta

SEQ ID NO: 49365 - DNA, 201 bp, Homo sapiens
ggattttaggatgacaagtgccaaaattgtttgggaagacaatattctatggctttcctaaaaagtaacaaaagcacggatcatcatctttgtcctacagwtgcctgaaataatgtcaaacaaacacccaagacaaggagttttagtatctcttggggtggacccaaatgcctcccacatggctctgctgagagagacaga

SEQ ID NO: 49366 - DNA, 201 bp, Homo sapiens
cttgtggaagttatttaacttctctgtgcctcagtttcttcatgtggtaaataaagataatgatagtacctacaagatagagctgttttgagaattaaatragttaatacctggaaaactcttgaaacattgcctggcatgtagtaagggcccaataaacgttaactgtcatcctcatcgttacatttcacttcttgagac

SEQ ID NO: 49367 - DNA, 201 bp, Homo sapiens
gcctatttctattcgatgtttccagcatggcaacatccaacttcagagtccaagaaggcagtactcaggtctctaggcaggcaaggtcaatgaagacactyactgtggcaaggtgtgaataatttgcatgaaacctgtggtcattgaaacaaagcccctttttgagacatgaggacacaggcctggccaaggtgggtctga

SEQ ID NO: 49368 - DNA, 201 bp, Homo sapiens
gagttcttacaagtcaataataatgagacaaatcactcaattaaaaatggacagaggaggctgggcatgttggctcacacctgtaatcccagcactttggraggccgaggcaggtggatcatgagatcaggagaccgagaccatcctggctaatacagtgaaaccctgtctctactaaaaatacaaaaaattagccaggcg

SEQ ID NO: 49369 - DNA, 201 bp, Homo sapiens
caaattccagttcaactagagagattcagcttcctggtgttcccagggggatctagctctgaaaagagcccctttcttctgtcaggacatcctcagcaaayaaggctgcaggtctgagctgagcagcctggagagtggggattccaactccccccgagagtgtctacctgcctggcttcctccctgaggaaagtcactgtc

SEQ ID NO: 49370 - DNA, 201 bp, Homo sapiens
ggggtgaaacactctcctttgagggattttaggttaaacactctcctttgagggattttaaatggtattgtagccgggacataagatatttgtgtatacaratttctccagtcaaaggatttcttttcaagagatatcttaaactttctggaggccactttgaatagaaacagtggagcatggttatatctgccctaggaa

SEQ ID NO: 49371 - DNA, 201 bp, Homo sapiens
aagatatttgtgtatacagatttctccagtcaaaggatttcttttcaagagatatcttaaactttctggaggccactttgaatagaaacagtggagcatgrttatatctgccctaggaactctcctaagctctatcaaagtgtagacttaaactcacacttctcattctgcttcttaacattaggcatcctggcatgcata

SEQ ID NO: 49372 - DNA, 201 bp, Homo sapiens
gggcggttgggtgaaaaggccgcggtggattctcggactgccgggtcagtccccaccagcgccgccgcctcctcgccggctttgccaccgggtgagcaggrgacgcgggacgcgggacgcgggacgcgagggagccgcgcggggcgtggactctgtgccggccccgccccccgcgcgcgcactggctgctccccgcgacgt

SEQ ID NO: 49373 - DNA, 201 bp, Homo sapiens
ctaaagaaatgataatggagctgaggtctggaagaagcataggagtttcctgaagagggtaggagggggcactgcacacagagggaacaggacagtcaaargcaggccatttggcaacaggtgactggaaggaactggaagaaggcccatgaggctgaagtacagagtgaatatgcagggtctaggcagaccatgcaagaa

SEQ ID NO: 49374 - DNA, 201 bp, Homo sapiens
gcactaccatgcctggctaatttttgtattttttgtagaggcagaatttcaccatgttgcccagtctggtcttgaactcctgggctcaagcaatccgcccrccttggcctcccaaagtgctgggattacaggtgtaagccaccgcacccagccctgattttctattataatggataaaaacttaattctcttacaccttcc

SEQ ID NO: 49375 - DNA, 201 bp, Homo sapiens
ccaactgcagaacacaaatcccactacaccaaagggctctgaattcacaaaaagattcccagttccagccgggcaccatttatttttcagcaacacttgayatgggcaaattccagttcaactagagagattcagcttcctggtgttcccagggggatctagctctgaaaagagcccctttcttctgtcaggacatcctca

SEQ ID NO: 49376 - DNA, 201 bp, Homo sapiens
atccttcaactgtagaggttctgatacctgtaactcctcagccttttaattttagtttgagtagtacaactgcttttacagctagatgcaaatatataacrgctcaaacaaaatagtttattttttcttaagtaacagtattagtggaaaagtcagcaagacagcctcttccatatagtcctttagagactcaaactaaca

SEQ ID NO: 49377 - DNA, 201 bp, Homo sapiens
aagggcaatatgcatgggtagggagggaatggggaggaaaatttcttggcagtctcccctttatcctctgctcttctcctctactttttaggcctccaagsctcagcactcatcctgtttctcattcttaaaggcctctctgttagctgaagacccaaaagagggttgctaggagaataggttgtaagcctagagtcacaa

SEQ ID NO: 49378 - DNA, 201 bp, Homo sapiens
gtttaggacttattcttttactgtcattttagtgaaattttggctgaaagcagaggtaaatatgcagctatattgttacttaagatatagtatatgtaggyataataaaatgaccagagaaaaacatctctgaggttcatatgggtttgttggctgtaaattttctattcctgaactatattatgagtactttttaattat

SEQ ID NO: 49379 - DNA, 201 bp, Homo sapiens
tgaatagaaacagtggagcatggttatatctgccctaggaactctcctaagctctatcaaagtgtagacttaaactcacacttctcattctgcttcttaayattaggcatcctggcatgcatataaggtctaattaagtcccctgcttcttggtcagtgtctttccccttcatacctccactttttgggccattgaaggga

SEQ ID NO: 49380 - DNA, 201 bp, Homo sapiens
tgaggtgagagaattgcttgaacccaggaggtggagatttcagcaagccaagattgcgccactgcactccagcctgggagacagagtgagactccatctcaaaaaaaaaaaaaaaaaaaaaaggaaaaaaaggctttttgaagaaagaaggggtagagatttctttcagtactatgtcaagagctgaggatatagctgaaa

SEQ ID NO: 49381 - DNA, 201 bp, Homo sapiens
tgttaggagattgggcttagcagtaacgtaaatgaagaagaaaataagaggaggcagaatttcacccaccgagatagggaataagggagaatgcgcaagtytgatagaaaatatcagtgggataatttacatttgaagtgcctgtggaatatctaagtagagaagttgaaaaaggcagttggatctatgggtctagaattg

SEQ ID NO: 49382 - DNA, 201 bp, Homo sapiens
taaagctgttgcttgtgttagggatctccatatctccaagtaaatggtgatactgctatttcttaattaactgtcttcatcactatctatctagtcttactttttttttttttttttttgaggcagggtctcgctttgttgcccaggctggagtgcagtggtgtgatcttggctcactaccacctccaccttctaggctca

SEQ ID NO: 49383 - DNA, 201 bp, Homo sapiens
gatcagttaatttaatatacaaatatttattgagtacctactacacatgtcatgcaataatttaagctttggagatataatagtgaaccaaaactgagttyctgccttgacggaactttcattcttgtgggaggaaggaggcagaaagtaaaattaagtaaatgtatataaggtaataataataaatattttctatggaga

SEQ ID NO: 49384 - DNA, 201 bp, Homo sapiens
gcattttcattcattcagggtggcctactgcaaattggtttatggtacctgctctgacaataccagtgaagtcctcacttgaaggaagtataaataagaakcaaagatagagctcagttatgggaggctccttcattatttttatggcacctgggggacaatgggaaagagggatgtggcctgtcactaagaagtctctgc

SEQ ID NO: 49385 - DNA, 201 bp, Homo sapiens
agaacagccaggttacagaaaccaaggcagaccgaggtagggctaggagagccgcaagcgctggggtgaggcagcatgcttaaactctcttggaactgttrttgcagccttagtacaatcttagaagtgaccttagaagtacattattattcttttactttataaatacatgtgggatagaccagtgttgactcaattttc

SEQ ID NO: 49386 - DNA, 201 bp, Homo sapiens
gacagggggcctggggtcaaagatggtactgtcctctttctatagaatgggatggatggctaagggttaccaatataaagaactgtatttgtcatccctcrgccactgtagtggtcctgggccaagtttatgtttaactttgtagttttatctggagttttcttgtagtttgattgttttcttgaatttcacaatcgcttt

SEQ ID NO: 49387 - DNA, 201 bp, Homo sapiens
gagtgagtttggaagcaactaaatcataagaatgcaaaacatgttctttattccaacagaggactaccaggaactcattgaagacatagttcgagatggcyggctctatgcatctgagaaccatcaggaaatacttaaggtgagtgcctggctcaggtggacatggcagttatccacagagcttcccgagtactgttggag

SEQ ID NO: 49388 - DNA, 201 bp, Homo sapiens
tcccgagagatgtttccaagatcgttcatccgattgctacgttccaaagtgtccaggtttttgagaccttacaaatgactcagcccacgtgccactcaatrcaaatgttctgctatagggttggtgggacagagctgtcttccttctgcatgtcagcacagtcgggtattgctgcctcccgtatcagtgactcattagagt

SEQ ID NO: 49389 - DNA, 201 bp, Homo sapiens; identical to SEQ ID NO: 49369

SEQ ID NO: 49390 - DNA, 201 bp, Homo sapiens
atctctgaggaaatgacatttgaacagagacctggaagataagagggacctaactattagaaatgttaggggaagaacatttcaggcagaggggacagccrgtgcaaagggattggaatgggaaagaaattttgagcaaggaagtgagtgtggatggtgttgaatctgaatgaataaagggagagtggtttgtatatggaa

SEQ ID NO: 49391 - DNA, 201 bp, Homo sapiens
agatgctgtctcaaaaacaaaaaacaaaacaatttaaaaaaagaggcttgataaaccatcactaaggctccccatgaggaactgggatgactcaaacagcrtcactcacccagtaccccccgggcccagtattcctaatgtacttctctgaaaatgcattatctacatttatcacactgataggtgccttctctaagattt

SEQ ID NO: 49392 - DNA, 201 bp, Homo sapiens
agaatctctgtctattagagcaggtctgtgtggtgtgccctatagattagctatccatatcaccacaaatcatgggctggagaatttcagaggcttagaaragaagcgtgaaataccagtataacaccaagatctggcacaaactgaagatttgcagagtcgtgattgcatcctcgtaatagcaaacattatttgaatact

SEQ ID NO: 49393 - DNA, 201 bp, Homo sapiens
gacgtgaggcagtgcctggcacatagcaattgttcagtaaatattaacttctgatgattgtggcttttattaggtagaatcctgaggcagggaaggacctkagttctggtcctggctttttcactgactcactgtgggatcttgggcaagtcagatgacttctgttttaattttcttcatgttagatgaagaggtggccca

SEQ ID NO: 49394 - DNA, 201 bp, Homo sapiens
gacaagtggtaatttgctgaaagcagaaagccttcatggagtagtaattaaaaagatgagattgggaaggaggatgaatggtagtggaaggtcttgaatgytaaattgaggatttttctttgttacaactagcaagagaaccactgtgggggaagaggaccatgaaagtaatgttaggagattgggcttagcagtaacgta

SEQ ID NO: 49395 - DNA, 201 bp, Homo sapiens
caaattccagttcaactagagagattcagcttcctggtgttcccagggggatctagctctgaaaagagcccctttcttctgtcaggacatcctcagcaaasaaggctgcaggtctgagctgagcagcctggagagtggggattccaactccccccgagagtgtctacctgcctggcttcctccctgaggaaagtcactgtc

SEQ ID NO: 49396 - DNA, 201 bp, Homo sapiens; identical to SEQ ID NO: 49363

SEQ ID NO: 49397 - DNA, 201 bp, Homo sapiens
taacattgattcttaaaaagtcctaatcaaacttctttatttggatgggccctaaatattcattttcagatttctcttcaaaagtttgaacatcatcattaaaaaaaaaatagcattaaaacaagcacttggactttgttatactggagcttggcctatatttctgagtctaaccataagatgaaaattcgaatgtcacat

SEQ ID NO: 49398 - DNA, 201 bp, Homo sapiens
gagggatgtggcctgtcactaagaagtctctgctttctatccctcaagcaacctcataatattctgcagaggcgcctcatggaaaccaacctgtctaagckccgaagcggtccccgtgtcccttgggcctctaagacgaacaaactcaatcaggctaagtctgaggggctaaagaagtctgaggaggatgacatgattttg

SEQ ID NO: 49399 - DNA, 201 bp, Homo sapiens
ggtctctaggcaggcaaggtcaatgaagacactcactgtggcaaggtgtgaataatttgcatgaaacctgtggtcattgaaacaaagcccctttttgagayatgaggacacaggcctggccaaggtgggtctgaccactgtgcagcatgtgccagggagagtacagaactcaaagtgcaatgtgctaacggagtgtagaca

SEQ ID NO: 49400 - DNA, 201 bp, Homo sapiens
agcttcagtaacttggccaaggtcccatagcaagcaaggggtggaaccagattcaaagctaagcctagactcctcacttccccacttccaccagacacacrtccttcagatactggtgtttgttttctttccattatttctcctcttttgctgtctgagttgaggtcaaagcctgttctcatcccgggaaatgaaaccaaa

SEQ ID NO: 49401 - DNA, 201 bp, Homo sapiens; identical to SEQ ID NO: 49369

SEQ ID NO: 49402 - DNA, 201 bp, Homo sapiens
ttccccttcatacctccactttttgggccattgaagggaagggaaatggatgacaagatagggcaggagaaaccagtgttttgaggaccaggggatgccarcatcgatgattcttgtgtgttctctcaggtttcaaagtgtgtctgctgagaggcttgctcagcaagtgtgaattcctgtcttttcaccctatccacccat

SEQ ID NO: 49403 - DNA, 201 bp, Homo sapiens
gaacttggtttttctttcccagcatcgtggatgtagactgagaatggctttgagtggcatcagcttctcactgctgtgggcggatgtcttggatagatcamgggctggctgagctggactttggtcagcctaggtgagactcacctgtccttctggggtcttactcctcctcaaggagtctgtagtggaaaggaggccaca

SEQ ID NO: 49404 - DNA, 201 bp, Homo sapiens
tgggccattgaagggaagggaaatggatgacaagatagggcaggagaaaccagtgttttgaggaccaggggatgccagcatcgatgattcttgtgtgttckctcaggtttcaaagtgtgtctgctgagaggcttgctcagcaagtgtgaattcctgtcttttcaccctatccacccatgggtgactcagtccacaggacag

SEQ ID NO: 49405 - DNA, 201 bp, Homo sapiens
cattaagtacaattgtatgaattgggtgaattttatggtatgtgaattatatcacacacagaaaccagtaactaaaaagggttaactggtttttgtgttamccagttaaccctttttaatgacactgacagttttgaattttaacattttgaatgtcaaaaatgtctgtgtcatggaggacaaagaaagctgtggaaatgt

SEQ ID NO: 49406 - DNA, 201 bp, Homo sapiens
cacaaaataatttcatattgataattactatgaaagaaatagtgagatttgttagtaactaaaaaggtgacctacctactttaagttgtatggtcaaggamggtatctctgaggaaatgacatttgaacagagacctggaagataagagggacctaactattagaaatgttaggggaagaacatttcaggcagaggggaca

SEQ ID NO: 49407 - DNA, 201 bp, Homo sapiens
tcacacactggggcctgttgcagggtagggggctgagggagggatagcattgggagaaatacctaatgtagatgatgggttgatgggtgcagcaaaccacyatggcaagtgtatacctatgtaacaaacctgcatgttctgtacatgtaccccagaacttaaagtattaaaaaaaaagaactctcacaattcaataataag

SEQ ID NO: 49408 - DNA, 201 bp, Homo sapiens
aagcttttgaaatatttaattttggatgtggttgtcggccctagttcactgaaattgccatttctggccccaggagggcagagcttctgcatccatttcctttttttttttttttttttttaatttaacagctctaatgatacacaggtacattatattatacacagtataatataatatacaaaaattatacacagtata

SEQ ID NO: 49409 - DNA, 201 bp, Homo sapiens
taaataatttaaaacttttaaaaatttaaagctgttgcttgtgttagggatctccatatctccaagtaaatggtgatactgctatttcttaattaactgtyttcatcactatctatctagtcttactttttttttttttttttttgaggcagggtctcgctttgttgcccaggctggagtgcagtggtgtgatcttggctc

SEQ ID NO: 49410 - DNA, 201 bp, Homo sapiens
ggagctgtcatttccctggtaaaattaaacagcaatttcattcacctttgcttctttttggatgaaggctggcaatggtttaaggaacaaataaatgaatkaataaatgagtggagttccctcctcctgactcagaaaggtgctatttcccctcacgcaggagatacaacttccatgcaagccagttctcccactacatag

SEQ ID NO: 49411 - DNA, 201 bp, Homo sapiens
gcagcgtgtcgcgcacggtcttgggcctgttgacccagtcctgctctccagacccgcggctcttgcccgcaccttccgcgctcagctcggcggccccggcmgcggtggacaggctgtcggccgggccccggtgcgcaggcggcggcggttgtttctccttggctgccgcctcacgctgctcgtgctccacggcagcgctgc

SEQ ID NO: 49412 - DNA, 201 bp, Homo sapiens
gcacagacagaaaatactcatatacgagtttcaggtgcacatgcaacttaaaaccttcaggcgtacgggattctgaggcagcagactgatttaaaatggasccactgaaaatgacacgcttgtaactgcctgtttgtacacatgcacaaaagtaccctcgtttgcactcaacatgtgactgctaatgtcccccaataggtt

SEQ ID NO: 49413 - DNA, 201 bp, Homo sapiens
aatctgatactgcccatgtacagtaagtagctttgtgacatttttatccagctgtggagaatctctgcactgtcatcaggtacaacaaaagatcaaacccmtgtcccgatgttaactttttaacttaaaagaatgccagaaaacccagatcaacactttccagctacgagccgtccacaaaggccacccaaaggccagtca

SEQ ID NO: 49414 - DNA, 201 bp, Homo sapiens
gcggggcactggttgccagagaggagtccgggaggctggcagggtgcactggctccagtcctcctgtgttgcctgctccctggccccccacctctctgggrcccagccttctttggttcatagaggacggagagggcggactgttgctattcctcctggtagtggagtgaacctggttggcatcttttgaggcatgactgc

SEQ ID NO: 49415 - DNA, 201 bp, Homo sapiens
tgaactccacaacaaaattccagcatgctggcctgctctacagatgttagactttccagtctccacaatcacatcagccaattccttaaaatcggtctctstctttctctatcctattggttctgtatattagtcaggctctggagagccctgacttatacagtggcaccaaacttgtttactaggaagggacaggcactg

SEQ ID NO: 49416 - DNA, 201 bp, Homo sapiens
tatctttgggaagaggttttgaaatgttgagaattacttctacaagctgcactattttcaatttcactaaaaataaaatttagcatttttgttacaaaaamatagttcatcctatttcttttaacctagttattacatgaaaaattgtttatcatctgtaacttgctaagaatatggtttcttgaaaaccttaaatggact

SEQ ID NO: 49417 - DNA, 201 bp, Homo sapiens
aagcagtccctgccacaaggagaactgcttcttgcctactttctcctgctttaccttaaatccccctaaactctgcacctgtaaaagcatctcaagacacwtcacccttctgattgggactttgatgtggttaccatacgccctctgactgcttctttctgtttttttttatccaggtctgtctgtgcggaccctctgtcc

SEQ ID NO: 49418 - DNA, 201 bp, Homo sapiens
ccccctaaactctgcacctgtaaaagcatctcaagacacatcacccttctgattgggactttgatgtggttaccatacgccctctgactgcttctttctgtttttttttatccaggtctgtctgtgcggaccctctgtcctggctgaacagcatttgtggggtccctgtgtttgctcaacatcccaaagcccccttaattt

SEQ ID NO: 49419 - DNA, 201 bp, Homo sapiens
ggagatggagctcaggaggtaatgctcgctcacctgccgctcacccgccgctcacctgccgctcacctcctgctgtatggcctggttcctaacaggccatrgacccatatggggctgcaggctgggggttggggatccctgctctaccgaatgcagggcctagggtctggggagacaaaaacttacaaattagtaaataat

SEQ ID NO: 49420 - DNA, 201 bp, Homo sapiens
aggaagctggcgtggctagcatgaacaaggataggagccatgtctgggaaatagcattgccttgatggccattgtaaagactttggatttgactctgaagragatagaaaggcaagaaaaggatttgagcaaaggagaaacaagatcagatgaatatttttagggtttattctggccgatgaactgagaataagttgcaga

SEQ ID NO: 49421 - DNA, 201 bp, Homo sapiens
cgcaccttccgcgctcagctcggcggccccggccgcggtggacaggctgtcggccgggccccggtgcgcaggcggcggcggttgtttctccttggctgccrcctcacgctgctcgtgctccacggcagcgctgctcgacacggatgccggccgcttgtgggcgcccagatcggtgggctgcgcggagcccaggctggcggc

SEQ ID NO: 49422 - DNA, 201 bp, Homo sapiens
gaactgccattttgtaaaatgggaaagactgaaaggggactgtggtgcggtggtgttgggcgagggtgggagggagatcagaagttcaacttcagacatayaaatgtgagacgtcaattagatattcaagcgaacaactgagtaggtagctggatataccaggctggcactcaaggacggaggtctaggctagagaaataa

SEQ ID NO: 49423 - DNA, 201 bp, Homo sapiens
aattgaactaaattagtatactgtacagcatgggcctggttaaattaaacataaatgctctgccccctgccacccacctcactctgaccacggagagttcrtttaacaggcgccactgtctgtgagacccaaacaaaggtagctgacttcaaaccctgtctacatttgccttattatagaccatgtgttagtagatgttgt

SEQ ID NO: 49424 - DNA, 201 bp, Homo sapiens
actgcctgtttgtacacatgcacaaaagtaccctcgtttgcactcaacatgtgactgctaatgtcccccaataggttaaaaggtgactggtgccctcatgrtcccatccaagaatgtgctgggaaaggaaaaccccgtgtcagagcgtatcagcccagtctgactcatctctgttatgctgcttcagcacatgaacacgtt

SEQ ID NO: 49425 - DNA, 201 bp, Homo sapiens
gggggtaatgggctcttagcctgggctaagactctcaacagcttttttctgttttgcagctcacacatacagtcggctcaggcagacggcccaagccaagsctgtgccaaagaaatgctgatttagtctgacccagacaatctctactcccacatgtcacttctctgcagaactcttactagtatggcaaatactttaaaa

SEQ ID NO: 49426 - DNA, 201 bp, Homo sapiens
tgattcatggattggagaattgaactaaattagtatactgtacagcatgggcctggttaaattaaacataaatgctctgccccctgccacccacctcactstgaccacggagagttcatttaacaggcgccactgtctgtgagacccaaacaaaggtagctgacttcaaaccctgtctacatttgccttattatagaccat

SEQ ID NO: 49427 - DNA, 201 bp, Homo sapiens
aaaatgggggtaatgggctcttagcctgggctaagactctcaacagcttttttctgttttgcagctcacacatacagtcggctcaggcagacggcccaagmcaagcctgtgccaaagaaatgctgatttagtctgacccagacaatctctactcccacatgtcacttctctgcagaactcttactagtatggcaaatactt

SEQ ID NO: 49428 - DNA, 201 bp, Homo sapiens
ttaatgctaaaagttaaagaaaaaaaggtactgtaaatctgacaaatgacagaattcaggtgatatttccatagcgtgattttaaaatataataatgttgrtatctgagattacactcacttcagttgacatgagtttcatcatatatagaaaaagtatcaccttcaacttaaaaaaagtaaaggttaaaaggtggcacac

SEQ ID NO: 49429 - DNA, 201 bp, Homo sapiens
agagaaacattttactcttcactaaccaaataaaaccatctataaatcatatgcaaaacaacttttgagtaaagagggacttaaaagtctaggaattaaaraaggatttccatagtttccttttaactctcccccaactcccctttggggaataaacaaagacatctgccacatcaagagtctggtttgttttcttaactg

SEQ ID NO: 49430 - DNA, 201 bp, Homo sapiens
gatttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaaga

SEQ ID NO: 49431 - DNA, 201 bp, Homo sapiens
atttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaa

SEQ ID NO: 49432 - DNA, 201 bp, Homo sapiens
ccacagccagcaccgtatcctcaggcaccccatgggacagtacatacagaagaacagcatcacaccacatcctatcaccaaggccaggattctgtgcctcygcccccctccccacctccttgaaacgggggaagtagggggaagagtcaattcttcttggagcacatgagatggtagcttgctgtgttgtcctgaaagaaa

SEQ ID NO: 49433 - DNA, 201 bp, Homo sapiens
tttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaag

SEQ ID NO: 49434 - DNA, 201 bp, Homo sapiens
ttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaagg

SEQ ID NO: 49435 - DNA, 201 bp, Homo sapiens
ggaactgcacacatgtgaacttcctgaggcctcttctctttagcacttaacaggtagctggattttaaacatttgtcaggctgcttttattctgtctaccyacctctcaattatctacctatctacctatccatctatctatctttgcattatcagaccaattcattattcttaacaatagttaagaacatcagtgtctgt

SEQ ID NO: 49436 - DNA, 201 bp, Homo sapiens
atctgaggactaagcttaggggcactccaacaagtgagacgatgaggaatcagtgaaagaacagccagtgaggttgcagaatgaagaaagtggtctctggmagcaaactgaagatactgtttcttaatacctttatatttaaggttagaaagaggtggagctggaagttaagagtaagccgtctgaccccagaggccatgt

SEQ ID NO: 49437 - DNA, 201 bp, Homo sapiens
gacagcaccttctcatgtctggttgataaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtg

SEQ ID NO: 49438 - DNA, 201 bp, Homo sapiens
acagcaccttctcatgtctggttgataaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgt

SEQ ID NO: 49439 - DNA, 201 bp, Homo sapiens
cagcaccttctcatgtctggttgataaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtg

SEQ ID NO: 49440 - DNA, 201 bp, Homo sapiens
agcaccttctcatgtctggttgataaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtgg

SEQ ID NO: 49441 - DNA, 201 bp, Homo sapiens
caatcctgactactttgcactcagacaaataaatacaatgggctacagggtaccgaaaagaaaaaagtgtgaaacaacattgtatagaatatcacagttgyaagggtacaagttgttcataaagtatgccaatgaactttcattgttattattattattatttgaaacagagtctttctctgtcgcccaggctggagtgca

SEQ ID NO: 49442 - DNA, 201 bp, Homo sapiens
aatacaatgggctacagggtaccgaaaagaaaaaagtgtgaaacaacattgtatagaatatcacagttgcaagggtacaagttgttcataaagtatgccartgaactttcattgttattattattattatttgaaacagagtctttctctgtcgcccaggctggagtgcagtggtgcgatctcagctcactgcaacctcca

SEQ ID NO: 49443 - DNA, 201 bp, Homo sapiens
gataaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaacc

SEQ ID NO: 49444 - DNA, 201 bp, Homo sapiens
taaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaacctt

SEQ ID NO: 49445 - DNA, 201 bp, Homo sapiens
aatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcg

SEQ ID NO: 49446 - DNA, 201 bp, Homo sapiens
tgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgct

SEQ ID NO: 49447 - DNA, 201 bp, Homo sapiens
tcccctttccttcccgtggagtaaacagagcttggcagggctggaggctttcttccttttaaaaagtgccattctgaacaacgatacaaagtgaaaaaatsaattttttaaaaaagaaagggaaaaactacaatttgaccattctgaccagcctccttgttccaactggcctcttgatttgtataaagataatggggtccg

SEQ ID NO: 49448 - DNA, 201 bp, Homo sapiens
ggctgtcccgaccaccctcaggatgttttcctctggtgtgcctctgggccaaatcgtgctaaaaatcattttttttcttttatgcaaggacactttgtcasttggtttccgtcagtctcctgagaatggggaatttaggtctagcgtggttcacagttctggttttttaggagttatacttgaaagctcaatgtcggacac

SEQ ID NO: 49449 - DNA, 201 bp, Homo sapiens
aaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttc

SEQ ID NO: 49450 - DNA, 201 bp, Homo sapiens
cacagcgcaggctccacccccttcggcgagtctgggcgtcgaggcgccgcccccgggcccgaacttggactcgaggtggcgggaggcgagggcgcgagtggggggggggggggtcctgctcgcctccgcgaggttcccgagggccgtgggggcgaccggctggctggctggcccgccgtcccgcagggcgggccgccgacg

SEQ ID NO: 49451 - DNA, 201 bp, Homo sapiens
cccttttctcccctagaccccctcacttcacagccgcccctacctgctttagacccgttggccccgttggcctcgaaacccaacaacctgcctgcagtcarggccggctccttcttaaacttgctctcgaagggccccgagtggccgtgctggtgcagcgccagcagcgtgtcgcgcacggtcttgggcctgttgacccag

SEQ ID NO: 49452 - DNA, 201 bp, Homo sapiens
acagcgcaggctccacccccttcggcgagtctgggcgtcgaggcgccgcccccgggcccgaacttggactcgaggtggcgggaggcgagggcgcgagtggggggggggggggtcctgctcgcctccgcgaggttcccgagggccgtgggggcgaccggctggctggctggcccgccgtcccgcagggcgggccgccgacgg

SEQ ID NO: 49453 - DNA, 201 bp, Homo sapiens
gtgaggcagtgggtggtggcggagacacaaaagaggatgtaggagtcatggggatcttgagcccctctgtggatgtggacagccacggctgggcctctccrttgatcttagggggcccgacttcaccttctggttctggagagggcttccttttccttgctgttcttgcaactggaaacacaaagaaataaaaggaaaaag

SEQ ID NO: 49454 - DNA, 201 bp, Homo sapiens
gggccgcttcaggcggtgtggtccggttggaatgaggtgaggcagtgggtggtggcggagacacaaaagaggatgtaggagtcatggggatcttgagcccytctgtggatgtggacagccacggctgggcctctccgttgatcttagggggcccgacttcaccttctggttctggagagggcttccttttccttgctgttc

SEQ ID NO: 49455 - DNA, 201 bp, Homo sapiens
ttatccaaaacggcaggatggttctgtattaatctttttggaaagcatgtctgtattaagattgcaaaacatacagatagctaccacaaattaggtcaaaygactgatcaagttgtaacatctgtgaggtcaaattcctataataaagtgcctagatacacatttatacaacagaccataagagctgaattctttacaaat

SEQ ID NO: 49456 - DNA, 201 bp, Homo sapiens
gcgcaggctccacccccttcggcgagtctgggcgtcgaggcgccgcccccgggcccgaacttggactcgaggtggcgggaggcgagggcgcgagtgggggrggggggggtcctgctcgcctccgcgaggttcccgagggccgtgggggcgaccggctggctggctggcccgccgtcccgcagggcgggccgccgacggagg

SEQ ID NO: 49457 - DNA, 201 bp, Homo sapiens
aaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttccc

SEQ ID NO: 49458 - DNA, 201 bp, Homo sapiens
accagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccag

SEQ ID NO: 49459 - DNA, 201 bp, Homo sapiens
cagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggt

SEQ ID NO: 49460 - DNA, 201 bp, Homo sapiens
gaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggttc

SEQ ID NO: 49461 - DNA, 201 bp, Homo sapiens
aatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggttcaa

SEQ ID NO: 49462 - DNA, 201 bp, Homo sapiens
cctgcgcgggccccctcccctcgtgcgcgtgcccgccctcccgcgcgcgcgctccccctccccccgcgcgccgaaggagcgctgccgggagagccggctaygcggcgcccgcccgcccgcggggcagcgcagcagcgcagcgccggtgttcccttcggaacaccgcgcaaagtgatcgagtgcttttcctccactttccct

SEQ ID NO: 49463 - DNA, 201 bp, Homo sapiens
tctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggttcaagt

SEQ ID NO: 49464 - DNA, 201 bp, Homo sapiens
ctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggttcaagtg

SEQ ID NO: 49465 - DNA, 201 bp, Homo sapiens
ctggatcacaaagaacaaactgcttggttagaatttggaagagtggctgggtgcagtagtaatataatcccagcactctgggaggctgaggcgggaggatyactggaggccaggagtttgagactggcctgggcaacatagcaagacccccatctctacaaaaaaaatacaaaaatcaaggccaggtagagtggcttacac

SEQ ID NO: 49466 - DNA, 201 bp, Homo sapiens
tgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggttcaagtga

SEQ ID NO: 49467 - DNA, 201 bp, Homo sapiens
catacaataaaagaaggcaaaacctcagtaatttgaggttcacttttaataaactctttccatgcattaaaataaattgaggccctgagctctggcgaaatttgtttccgggtttttaattcccaccgcccccccaccccggaggcataaatagccacatacgcaattcaaagtactctatttgaactagtataggaaaga

SEQ ID NO: 49468 - DNA, 201 bp, Homo sapiens
gcctaaatgtagtgtgtttactacaaagcttgtcacagacagctaaaatgcaaatacaaatgaactttgatgtacttcgtggcaagactcccagcccttcragcaaattcctgagtgaggaagctggttctgaaacatgcctgggaactgcacacatgtgaacttcctgaggcctcttctctttagcacttaacaggtagc

SEQ ID NO: 49469 - DNA, 201 bp, Homo sapiens
gtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttcgcttcccaggttcaagtgat

SEQ ID NO: 49470 - DNA, 201 bp, Homo sapiens
atacaataaaagaaggcaaaacctcagtaatttgaggttcacttttaataaactctttccatgcattaaaataaattgaggccctgagctctggcgaaatktgtttccgggtttttaattcccaccgcccccccaccccggaggcataaatagccacatacgcaattcaaagtactctatttgaactagtataggaaagat

SEQ ID NO: 49471 - DNA, 201 bp, Homo sapiens
tatatatatatatatatatttttttttttttttaagacagagtctcactttgtcgcccaggatggagtgcagtgtggcgatctcggctcattgcaaccttygcttcccaggttcaagtgattctcctgcctcagcctcccaagtagctgggattacaggcatgcaccacggcgcccagctaatttttgtatatatagtaga

SEQ ID NO: 49472 - DNA, 201 bp, Homo sapiens
gtacttttgaagttgttttctgttggcaaatgacctcttgattattttcatgtggtgagtattcaggccaacctttttggttccaagtgatttaaaaacayacacacacacacacacataaaaacaaaccactctgaagtgtccatattttagcataaagttaggaattatgcgagtgctgggtgtatcacggtcaattct

SEQ ID NO: 49473 - DNA, 201 bp, Homo sapiens
taaatgaatgaataaatgagtggagttccctcctcctgactcagaaaggtgctatttcccctcacgcaggagatacaacttccatgcaagccagttctccyactacatagagcccttctgtttttaggaagttctgattcatggattggagaattgaactaaattagtatactgtacagcatgggcctggttaaattaaac

SEQ ID NO: 49474 - DNA, 201 bp, Homo sapiens
ggtttggtcactcccaggccctgctgttgcacaccgctttcaagacctgtccctttggtcaccctcctcagagaccctgtgacactcattccagtacatgscttcacccactgcgtcactgcccaaaggggatgaagtccagtccttgtgctgcagagaaatgaaccaactcatcgcccccaagagacggccccactaagc

SEQ ID NO: 49475 - DNA, 201 bp, Homo sapiens
tgaattccggtatgcattggcacatccatttctgtgcccacatggtaatgcctctttgtgaggcagagtgcaaaaccactgggaaaattaagaatcacacycagaactgaagttcatacaggggagaaggaaacagacatgcagtaggcagcctagatgtgagccctagcaagagactactgatggattccccaaagtgac

SEQ ID NO: 49476 - DNA, 201 bp, Homo sapiens
catagtgaaggtacagacacgagaatcagagagagaagatgcttaaaccttaagcaagtcagacctagggtctacctgactgtagattttattagttcccmgagccattaagttccctttatagtttaagcctatttgagtaggattttctgtgatttttgcccttgaaagcatcgcaactggtagaggcgtcattgtctg

SEQ ID NO: 49477 - DNA, 201 bp, Homo sapiens
actaaaataggagctggatacacagtgcccaagtcctcgtgagagtttcccaagaagggtttaccatggagaatgtgtcatcagttccttttcagttaggkcttttgaggatgaggaactgaatcctaaattcacccaaaggaaaaatggccaacagggcagcaactaagcctggatcacaaagaacaaactgcttggtta

SEQ ID NO: 49478 - DNA, 201 bp, Homo sapiens
ttcacaaacattatacatattttgcttgggaaaaatgagggcttgcaatggggattttgttgacattggctgctgctgctactttcatttctgctttttcyttctccttctctttctccttttccttcgtgttaatcaaatctctctctctctctccagtccttttgctgtaggctataagactgttggatcataataaca

SEQ ID NO: 49479 - DNA, 201 bp, Homo sapiens
aaacattatacatattttgcttgggaaaaatgagggcttgcaatggggattttgttgacattggctgctgctgctactttcatttctgctttttctttctycttctctttctccttttccttcgtgttaatcaaatctctctctctctctccagtccttttgctgtaggctataagactgttggatcataataacaatcta

SEQ ID NO: 49480 - DNA, 201 bp, Homo sapiens
agaatgagtataaacccgtctgtaagcaaaggggtttgggggatttgtataatccattccatggcacgtcttaactaatattccctgtactgataaggccaaaaaaaaaaatgtaactctcaaatagcaaaaagaagaaaatgggattagagttagatcagcttcactttataactataaataatttaaagcaagtcgctc

SEQ ID NO: 49481 - DNA, 201 bp, Homo sapiens
attccctgtactgataaggccaaaaaaaaaaatgtaactctcaaatagcaaaaagaagaaaatgggattagagttagatcagcttcactttataactatawataatttaaagcaagtcgctcggctttgcctcagttttctgttctgtaaaagtgtttcttagaggcggttatgaggattaaatgacccgacagaggcaaa

SEQ ID NO: 49482 - DNA, 201 bp, Homo sapiens
tataaaaatggtaaattttcccttcttagcttttctattaaaaaatgtacatttcctacatacacattccatagcataagaactgaaaaagtcaaataatstaataattctaaaacgttaaagaacagtacgatggcatggtatttgctgtatctttcacatgaacattttaaaaagatatttcaaggataaattctattc

SEQ ID NO: 49483 - DNA, 201 bp, Homo sapiens
tattagttcccagagccattaagttccctttatagtttaagcctatttgagtaggattttctgtgatttttgcccttgaaagcatcgcaactggtagaggygtcattgtctggggatggaaaaggaaacttggaaagtggccatgatggttaatgtcatgtgtcagcttggctaggctatggtgcccagttggccaaacac

SEQ ID NO: 49484 - DNA, 201 bp, Homo sapiens
cagttctggttttttaggagttatacttgaaagctcaatgtcggacacatagcatgaaatccgtcactggtgctttgcatttgtcttggaaaggacatacrccccgcctgtcccttttactaactagggagactgtgaatattcccaagcccagcaccacgtgcacacgccgccagctggctcgcgcgttttccacggagc

SEQ ID NO: 49485 - DNA, 201 bp, Homo sapiens
ttttttttttttttaagacagagtctcactttgtcgcccaggatggagtgcagtgtggcgatctcggctcattgcaaccttcgcttcccaggttcaagtgmttctcctgcctcagcctcccaagtagctgggattacaggcatgcaccacggcgcccagctaatttttgtatatatagtagagacagggtttcaccatgtt

SEQ ID NO: 49486 - DNA, 201 bp, Homo sapiens
cttcaagtaaagcaaattaccctccataatgtagatggacctcatccaatcagctgaggacctttaaaacaaagactgaggtttcctgaagaagaaggaaygggacctcaagtttacagcataaatgtcttgcttaagtttctagcctgcagattttcagactgaagactgcagcatgaactccacaacaaaattccagca

SEQ ID NO: 49487 - DNA, 201 bp, Homo sapiens
tctaggaattcacaagcctgaagcaaggcttttttttttttttctagcctcctatccattcaccggttcattcacttttaaacaatcactaaaactattayacaatacttattccacaatctagttgctacttctggtagccagcaccctgcccccccaactccaaggctggtgatggagaaatagtttaatgtcagtttt

SEQ ID NO: 49488 - DNA, 201 bp, Homo sapiens
ttattagcatgcaccatccattagtgctaacacagatgcttcttaaacacgcgtgtttacttcaccagcacggaacatttggcttattatagctgcagccaaaaaaaaaaaaaaaaagcagcatcatgatttccaaaaagggagtgacatttgatttggggcagctcttgtcatgcgccatctccaacttagaaaatccac

SEQ ID NO: 49489 - DNA, 201 bp, Homo sapiens
tatgttttagtcacgtagactctgccctcttgcttgaggcaccaggtcctctcaaaagagaattatgatcatctttgccacccagagtcaaggttaccggsttggctgcagtgtgctcctgcacattcatatacggacaggcaggcagatgctgggccaagtgtcggcgacgcagcgggatgaggctggcttttcaccaga

SEQ ID NO: 49490 - DNA, 201 bp, Homo sapiens
aagtctgggattatgttaagtggcaaaacctaaggataatcagtgttcttgagaagaagagaaatctaaaagtttggaaaacatatttggaggaataataraggaaaatttccccagccttcatagagacctagacacccaaatacaagaagcacaaagaacatctgagaaatttatcacgaaaagaccatcacctaagta

SEQ ID NO: 49491 - DNA, 201 bp, Homo sapiens
tatttatctattccccaacatttattctttccttcttccttgcaataatactgatttttagctgagcaacctggaataaaccccaccagaacaaatttagycacctggaataaagacatttcccagctaggtatcaccacatgactaagctttatataatatcccttcctgttagctgcaatgcacatgtaatcgctggaa

SEQ ID NO: 49492 - DNA, 201 bp, Homo sapiens
agagaaatctaaaagtttggaaaacatatttggaggaataatagaggaaaatttccccagccttcatagagacctagacacccaaatacaagaagcacaargaacatctgagaaatttatcacgaaaagaccatcacctaagtacattgtcatcaggttacctaaagttaagatgaaggaaagaatcttaagagctgtgag

SEQ ID NO: 49493 - DNA, 201 bp, Homo sapiens
gtaaaacagaaacgattcattctttaaaaaatttaaccactaattttccacagaactacatgattaaagatggctttcaaatgaacattgactacaagtgttttttttttctattaattttttttttttttaccacatttcaagattcatctgaggcttgagttatccattaccaagttgttttttaatgcttccccattg

SEQ ID NO: 49494 - DNA, 201 bp, Homo sapiens
ttattttggttttttccttgcagccattttataactgcaactagttttttcccttagggcaagaaactttccaatccagttttataccccataaagactckcacactatatggattcaataaatattcgtcgattgttccactgtgtcagtgttacattctgagacacatcaataatttccctagggttaataaaagtaat

SEQ ID NO: 49495 - DNA, 201 bp, Homo sapiens
agcagccactttggactatgagatggaacatcaaagacaggaaaacaaaaagacagaagtttgaatccctgatgatttcaaagactgcctacttctagactttttttttttttttttgaggcagtcttgctctgtcacccaaactggagtgcagtggcacgatctcagcttactgcaacctctgtctccagggttcaagca

SEQ ID NO: 49496 - DNA, 201 bp, Homo sapiens
tcccttagggcaagaaactttccaatccagttttataccccataaagactcgcacactatatggattcaataaatattcgtcgattgttccactgtgtcartgttacattctgagacacatcaataatttccctagggttaataaaagtaattgtaaacagttggatactctgatgtaccacaggttggctaaatatagca

SEQ ID NO: 49497 - DNA, 201 bp, Homo sapiens
agagagtctcagacagatgggggaacgccagactgggtctacaaaaacggtttaggacttagtccagcagcagagtaagcgctggtggggagggggcattrccgagtgccttccagacacaagtgagaaggatgttccaatggcctgaaaattaaaaagaagacctaagatcatgagcaaattgctacaaatgtgagaaga

SEQ ID NO: 49498 - DNA, 201 bp, Homo sapiens
ctatattactttttgtgtctctgttacttgcagctaaacctaattctaactgataatttattatagattcctggttcattctgcctagatgaatgcagtctttttttttttttctttgagacggagtcttgctctgtcgcccaggctggagtgcagtggggcgatcttggctcactgcaagctctgcctcccgagttcgcg

SEQ ID NO: 49499 - DNA, 201 bp, Homo sapiens
atgggaataatcactgccaaaataaaaagctatttatttcagatctattcatgcttttaagattttgggggtactatctcaattttttaaatgacatttartatatgaattagctttattgctctctgctttcccccatcttttaaactaacaaaaaaatatgaattttaatttttagacaatttattcagccttgctatt

SEQ ID NO: 49500 - DNA, 201 bp, Homo sapiens
ggtggggagggggcattaccgagtgccttccagacacaagtgagaaggatgttccaatggcctgaaaattaaaaagaagacctaagatcatgagcaaattrctacaaatgtgagaagaacatgctggctgaaacaaaaataaagcacctaaatagataactatataaaaataaaagttttgaagaaagttatggacaaaat

SEQ ID NO: 49501 - DNA, 201 bp, Homo sapiens
ccctattcagccaacatatcatagatactgtatagtaacatctgggaatattaaactttgcctttactggcaacccaattggcatcttgaatttacagtgmagatgttttatactgatgtgttttggaaatctttgaagtattctcaagacagtattctgaggtttctgcagtggtccacttgagccttttgaagttccct

SEQ ID NO: 49502 - DNA, 201 bp, Homo sapiens
catttttgttttgttttgttttgttactgagagagagtctcgctctatcacccaggctggagttcagtggtgtgaactcagctcactgcaacctccgcctyctgggttcaaatgattctcctgcctcagcctcccgagtagttgggactacaggcacccgccaccacacccagctaatttttgtatttttagtagagatga

SEQ ID NO: 49503 - DNA, 201 bp, Homo sapiens
tgtgaggctgagaaaagtaagttttctgcatttaggcttgtttatctactgcttactatctcttgagagtattgtgaggatagttgcagcacttgaatatktatcatcctcctttttttcttcaatcactttcctttatagcataactaccaggtgcttccttgattctctttctattcatttcttctctctctctctctc

SEQ ID NO: 49504 - DNA, 201 bp, Homo sapiens
cactgcaacctccgcctcctgggttcaaatgattctcctgcctcagcctcccgagtagttgggactacaggcacccgccaccacacccagctaatttttgkatttttagtagagatgaggttttgccacgttggccaggctggtctcgaactcctgacctcaggtgatccacctgccttggcctcccaaaatgctgggatt

SEQ ID NO: 49505 - DNA, 201 bp, Homo sapiens
agtcttattgtttgccctaataaaatcactttcttgcaaaactattatagaatattttcatgtccctaatctagacttttatgttactgtattaaatgtakgaaaataagcagttattatgatgaatatatactttattaagattaaaatactaagatattttatctaccttttaattttctctgacagaatgttaatatt

SEQ ID NO: 49506 - DNA, 201 bp, Homo sapiens
gctgaggcaggagaattgcttgaacctgggaggtagaggttgcagtgagctgagattgtacaactgcactccagcctgggtgacagagtgagactgtcttaaaaaaaaaaaaaaaaagaaatgcaaaatgttttggaaaatctcagcaatagaatcgaacaagtagaagaaagacattcagagctcgaagacaaggtcttc

SEQ ID NO: 49507 - DNA, 201 bp, Homo sapiens
tactctgctacatagaaaatactttaaagaaaatgtaaattggattaaaatatactgtaacaggccaaaaattaaattaaatatcattgctttctcagtaggtttttaaaatttcagttcttgagtattatttactcctaaaagctgaaaattatgtgctaatttatctaattgcctttaacttttattttgaataatttt

SEQ ID NO: 49508 - DNA, 201 bp, Homo sapiens
tctgcaaaaagaagtatttttgcatgatgttttgaataaagttaaagggatgacagttgttttattacccaatactaatgtaagattcattttttaagacytaagggtattgcacagtctagagataagtggacatataaatatagttggttgtatcagttcctgcctcatgaaactccaactagcagtaggccctaaatt

SEQ ID NO: 49509 - DNA, 201 bp, Homo sapiens
ctcatcagatagccaatgggagatggcaactaggcagcctgggggtcagcgaagaggtaaaggaatttgaaattcatcagcctctagatggtaaagtcgtkaagttaaatgagatcatgtagggaataagtgtagacaggaaagaggagagggccaagaatggacacgccaacatttccaggtcagccagaggaaactgaa

SEQ ID NO: 49510 - DNA, 201 bp, Homo sapiens
ccttcttctggtccaggatctcacattgcatttagttgtcatgtccctagtttccaatcagtgacagttcctcagtttttcttttatctttgtcttccatracattgacacttttgataaatactagtcagttcttttgtgcaatgtctcttaatttgagtttgcctgatatttctcatgataaattgaggttatgtgttt

SEQ ID NO: 49511 - DNA, 201 bp, Homo sapiens
gggcatggtggcacgcacctgtagtcccagctactcaggaggctgaggcaggagaattgcttgaacccaggaggcgggggttgcagtaagccgcgattgcrccactgcacttcagcccggcaatggagcgagactccgtctcaaaaaaaaaaaaaaaaattagccaggtgtggtggtgcgtacctgtagtcccagctactc

SEQ ID NO: 49512 - DNA, 201 bp, Homo sapiens
agtcttattgtttgccctaataaaatcactttcttgcaaaactattatagaatattttcatgtccctaatctagacttttatgttactgtattaaatgtawgaaaataagcagttattatgatgaatatatactttattaagattaaaatactaagatattttatctaccttttaattttctctgacagaatgttaatatt

SEQ ID NO: 49513 - DNA, 201 bp, Homo sapiens
ttagttcctaagagagcaatggtaaaatatatcagccagtggcaatagatatcaagaatttagcaagaaaactaaaacaatagtttgtgactgaactccartgagcctcagataaagtctttactttcccactctctttaatgaggtgggttggaaaacggtttctcaaccctgagagttgaagccagtttagccacagag

SEQ ID NO: 49514 - DNA, 201 bp, Homo sapiens
aaatcattttaatgcctcatatttatgaagcactcatatttctaaagtacagatataaaattttaaatttacctctgagcatctgatatttcagctgtgcyttatccaagggtgataccccacaatggtggtcactgcctgtgtgtgaggaaatgctaatgagcccactgtgaaatgatgagtccttccacagtgttcgcc

SEQ ID NO: 49515 - DNA, 201 bp, Homo sapiens
tgaactcccttggattagccaaatgttaaaatgcacactgcttcaattcttttttaatgtaaaatacacataacataaaatttgtcattttaatcattttyaagtgttcagtgtcattaaacacattcacattgttgtgttaccatcaccaccatccatctctttttcatcatcccaaactgaaacccggggcccattaaa

SEQ ID NO: 49516 - DNA, 201 bp, Homo sapiens
aaatgcaaaatgctggccgggagtggtggctcacgcctgtaatcttagcactttgggaggcgggcggatcccctgaggtcaggagtttgagaccagcctgrccaacatggtgaaaccctgtctctactaaaaaaaaatacaaaaattagccaggcaaggtggtgtgcacctgtaatcccagctacttggggagctgaggca

SEQ ID NO: 49517 - DNA, 201 bp, Homo sapiens
agtgatggaagtttgagaagagagaaggtacaaaatattctagtcacttaaagcagtagaactccagatatattctgcagaccagtgttttttgttttttkttttttttttgcaaattatttgttatctttccatgaaaagatgagttcagaaattaagaatatgtatttagaagattccgtagcaactggacagagtaaa

SEQ ID NO: 49518 - DNA, 201 bp, Homo sapiens
cgttttcctttaagttatgaagggaatccagaacaacacagtatggatccctctgtgggtagcgcggaaaggcaaaatatatttataaaatgatgaattgsatcaggtgcagtggctcacacctgtaatcccagcacttccggagacctaggcaggcagactgcttgagctcaggagtttgagaccaacctgggcaacctg

SEQ ID NO: 49519 - DNA, 201 bp, Homo sapiens
agaacaacacagtatggatccctctgtgggtagcgcggaaaggcaaaatatatttataaaatgatgaattgcatcaggtgcagtggctcacacctgtaatmccagcacttccggagacctaggcaggcagactgcttgagctcaggagtttgagaccaacctgggcaacctggtgaaaccctgtctctacaaaaaaaaata

SEQ ID NO: 49520 - DNA, 201 bp, Homo sapiens
ataaaaaacagttgttaggttttttgcatcatttccagtgttctggtaagaacaaaatacatatgcatgcacaagctacaaaatacaaattatattatatmagtggttctaaatacagttttgcatttaaaactggcattccataatataaagatgaatggtttttaaaaattatgccaataatttaaatttttaattttt

SEQ ID NO: 49521 - DNA, 201 bp, Homo sapiens
taaaaaacagttgttaggttttttgcatcatttccagtgttctggtaagaacaaaatacatatgcatgcacaagctacaaaatacaaattatattatatcrgtggttctaaatacagttttgcatttaaaactggcattccataatataaagatgaatggtttttaaaaattatgccaataatttaaatttttaatttttc

SEQ ID NO: 49522 - DNA, 201 bp, Homo sapiens
ttaaaactggcattccataatataaagatgaatggtttttaaaaattatgccaataatttaaatttttaatttttcttcacttagaccagcattaaataamaaacaacaccatgacaagtcaagagaaagactgtggaagcaagaaaaaagctttacctttaagtatctttaatggcacttttccccagatttcaaaacaa

SEQ ID NO: 49523 - DNA, 201 bp, Homo sapiens
aaggatgttccaatggcctgaaaattaaaaagaagacctaagatcatgagcaaattgctacaaatgtgagaagaacatgctggctgaaacaaaaataaagyacctaaatagataactatataaaaataaaagttttgaagaaagttatggacaaaattaccatgctttaattggtgtaactttttaatttgaatttttggg

SEQ ID NO: 49524 - DNA, 201 bp, Homo sapiens
tgaaaattaaaaagaagacctaagatcatgagcaaattgctacaaatgtgagaagaacatgctggctgaaacaaaaataaagcacctaaatagataactayataaaaataaaagttttgaagaaagttatggacaaaattaccatgctttaattggtgtaactttttaatttgaatttttgggtacctagatggatgagat

SEQ ID NO: 49525 - DNA, 201 bp, Homo sapiens
aaaatactttttatggttatcaccactgaggcttaactacaaataaagtgaagtaaaagaaagcttccataatcaaattgcttccacaattctatccttgytatgacctccaacaaggacaaagatgctgtgaactactaaatcctccaaaatagttctttaatgtaggtatgtcttctttgatgttgtaaaattatcatg

SEQ ID NO: 49526 - DNA, 201 bp, Homo sapiens
  misc_feature (1)...(201): n = A,T,C or G, or insertion/deletion polymorphism (see Tables 1-2)
aactacaaataaagtgaagtaaaagaaagcttccataatcaaattgcttccacaattctatccttgctatgacctccaacaaggacaaagatgctgtgaantactaaatcctccaaaatagttctttaatgtaggtatgtcttctttgatgttgtaaaattatcatgcttcattttgttttgaacattctagaaagaattc

SEQ ID NO: 49527 - DNA, 201 bp, Homo sapiens
tttagaagactcctggaaccctatgattgccacaagatcatgcctgaattagcctgctgtgggatgacatacaaggaacaaatgagctgtcccagtggagkccacgctagattaggcaaacagctggtcaactgtgagagagccctagctgagatcagaaaagccatacagtcaagccccgccaaaatcagcaaaactgcc

SEQ ID NO: 49528 - DNA, 201 bp, Homo sapiens
cccctccacccctgctacctggtagctagagtcttgctttgaactaaacagaatttcacagccactattcttccattttacttaaattatcaccacttaawgaagatccatgccatgaggcttcactaagaaaatctgacattttaagtatcagtattaattgaatagagtggaagttcacgctagccccttggacactag

SEQ ID NO: 49529 - DNA, 201 bp, Homo sapiens
agtcttattgtttgccctaataaaatcactttcttgcaaaactattatagaatattttcatgtccctaatctagacttttatgttactgtattaaatgtargaaaataagcagttattatgatgaatatatactttattaagattaaaatactaagatattttatctaccttttaattttctctgacagaatgttaatatt

SEQ ID NO: 49530 - DNA, 201 bp, Homo sapiens; identical to SEQ ID NO: 49529

SEQ ID NO: 49531 - DNA, 201 bp, Homo sapiens
aggtagaggttgcagtgagctgagattgtacaactgcactccagcctgggtgacagagtgagactgtcttaaaaaaaaaaaaaaaaagaaatgcaaaatgytttggaaaatctcagcaatagaatcgaacaagtagaagaaagacattcagagctcgaagacaaggtcttctaattaacccaatccaacaaagacaaagaa

SEQ ID NO: 49532 - DNA, 201 bp, Homo sapiens
tgacttctgtctgtttactttttgaattcttatcatgtttattacgttgcaatgcacgtcttctctgagcaagcaagaatgctaatgcacataaaaaaaaatagagaaaacaaacctaggaaagttctttccaaattaaaaagagttaccaaaacaactgattttcttttttatttaacatgcagcaaaagcctaagtttt

SEQ ID NO: 49533 - DNA, 201 bp, Homo sapiens
tctggacacaggatctcttaagaccggggaaaagtctgggagagagaatcgtggagagactggagccagcgcgagtctgcgagtccgagtccgggcgcgcyagagcagaggggcgtcctcgctctgcctctcactcacttggtctgagccatcatggactctgcgtgctcctttgctgaagatttcacacccaaatttgct

SEQ ID NO: 49534 - DNA, 201 bp, Homo sapiens
atgtttttcattgttaaagttaacagaatgaatacatatccaatcagtaacaacgactaagtgtctatcttgcagaaagaaacatagatctaagtgagagrgtcaacttacagagattatatatcaaaaataatgaaaaccattaggcatatttgtagcaagaaactgcattcagcttattcataacctgctggcatgtta

SEQ ID NO: 49535 - DNA, 201 bp, Homo sapiens
ttttacctaccaacatcctttccttcattcacttcatataggtctgtgttttggtgggattttcttgatgttcttttaagagatttaggtaaaacatttcytaggacaattatatttttacatcagtgtgcaaatttccattcctcttaagattcatgacccaatgattaaaatttgtctgctcaaacatctaattaattt

SEQ ID NO: 49536 - DNA, 201 bp, Homo sapiens
aatattatgttaaaatgctacatctaaattgcaaaattttaatttacccttttactaatcttcatcgtttgttacaagggaaaaacaacttttcttagccwtattaatttttgttgatctttttaaaaagattgaatatctgaatgggtaaacaaaacacagcaaaaccatttgacaaggcaccatagatttttgccctct

SEQ ID NO: 49537 - DNA, 201 bp, Homo sapiens
ggcattcaggatgtttatgtgtctcctttggtaaaattaaagtgcataaatatatgcacacacatagtctatgtgtaaactccttttaaaccataagaatrtatgtttacttatgtttttcattgttaaagttaacagaatgaatacatatccaatcagtaacaacgactaagtgtctatcttgcagaaagaaacatagat

SEQ ID NO: 49538 - DNA, 201 bp, Homo sapiens
ttcctgggagcgcttactaagacctaaaacactgggagctgtcccttcagcacttccgtcctgttatggcaggaggtgctgaaaaggtgaggtgccccatrcaatgtttctggtggataaggtctgagctttggtaagctcactggtcattttctcctagtgagttcctagcagagaagacgtttcagatggggcggagcc

SEQ ID NO: 49539 - DNA, 201 bp, Homo sapiens
ttagtgcaactattctacctttgatcaaatattaaaccactgcctgcatatgaatgaacgcaagctctgaaactgggagatgcagggttacacgtgtggggagagcactcgtctcgcctctctccctcacacacacactcccacacatatgtctaagtccccgtgtcttgcagagtcacgaatggtgacggatggtaggaa

SEQ ID NO: 49540 - DNA, 201 bp, Homo sapiens
ccgactataacattcctgtctctccagctaggaaaagccacgttcaaagctctgtctgtgtatcgtggtccaaagtcgcacttacctaaggccccctctgracacaggatctcttaagaccggggaaaagtctgggagagagaatcgtggagagactggagccagcgcgagtctgcgagtccgagtccgggcgcgccagag

SEQ ID NO: 49541 - DNA, 201 bp, Homo sapiens
ctacactgaccatgctttaggtaagagttctttcaaatacattgctcagcttctagttgtaagaaagtagcagccccccacaccttgccaccaaataaagygattatggacaagaatgaatccagtaattactgataatttttagttttattttctggatactgattattttaactcaagtctatttaaaagtgtcttcat

SEQ ID NO: 49542 - DNA, 201 bp, Homo sapiens
acttgcaatttatgaacacccgattttaaggtgagcccattaaaaatacaactatttagtgcaactattctacctttgatcaaatattaaaccactgcctrcatatgaatgaacgcaagctctgaaactgggagatgcagggttacacgtgtggggagagcactcgtctcgcctctctccctcacacacacactcccacac

SEQ ID NO: 49543 - DNA, 201 bp, Homo sapiens
aaaatagatttgtcattaaattacatgtcaccatttttattatttgaccatttagaggtaaattaaggctgtgatagtaaagatctcatattattctctaraacaaaaatacaataatgcaacctacctcccaatcctggtctcaggcgattgtcataaccatctaggagtctgtccaaaatcctggtgaagacagtggta

SEQ ID NO: 49544 - DNA, 201 bp, Homo sapiens
catgggacaaaatgattggtggtttttatctgcattgtttgaaaagtgtcgctctacacattggctgaaatacagcacataacatttcttttttctttttwtcttttaatggtgtcatcagacaacagatgtatcatgtctacacaatacgatgagtagaagtgcctaaatcaatcatgtagcatgaggatatagctgatc

SEQ ID NO: 49545 - DNA, 201 bp, Homo sapiens
aaaatagatttgtcattaaattacatgtcaccatttttattatttgaccatttagaggtaaattaaggctgtgatagtaaagatctcatattattctctawaacaaaaatacaataatgcaacctacctcccaatcctggtctcaggcgattgtcataaccatctaggagtctgtccaaaatcctggtgaagacagtggta

SEQ ID NO: 49546 - DNA, 201 bp, Homo sapiens
gctactaaaataaaatataaatataaggaaaaagagaaggaggaggcagaagacaagaagaaaaacaaacaaacaaaaaacccaacaaattattgagagamtcatcttccaagaactaagctcactgctttacatattttttctaaacttcaaaagtgctcaataaaatgctgcagtgctcctttcagagacagaaatgaa

SEQ ID NO: 49547 - DNA, 201 bp, Homo sapiens
cagcagatttgctcatagccatggaagatagagatagtgttcctctctgcaaggggcaggtacacttacttctcatagtgaaagaggtgggtttcctaaawtgaggatctatctactgtaattcacccaatttcatctgtagatgtcacttggccctcttcacgttgccctgtgggaattggggtaaagggcactgatgca

SEQ ID NO: 49548 - DNA, 201 bp, Homo sapiens
tgaattcccttagtcataaattcatttgaggacaattttcttcccccgataaaataaatgaaaagttacagaaattttcatgcagatttttaaaaaagtgrccccaccttcttccagtcagtgtgctcagaaggaggatccaggcccaaagacagtcagacagacctggacttttcctcatcgcgggctggagcagctgaa

SEQ ID NO: 49549 - DNA, 201 bp, Homo sapiens
ctagaaccagggatcctagggatgcctaatcactctatctccagtgctgcagtctggtacctttcgcttttactgtcaattttaaatggcaggaagccctkacctaattgatgaagtggtgctgattctattcaacagagaaacgtttttactttctttaactaaacgtgaaccaaatgagaaaaaaatagcaagagtgtt

SEQ ID NO: 49550 - DNA, 201 bp, Homo sapiens
tgctgcaaaagaaattttttaaatttatagagcatagaagcagcaacatttctggaatccaagagcctgaaagtctcagctggttgcctcgtctgtctactttttttttttttttttttgccatagtacctcagtttatttggatattggcccttaaatggctcagaacggaaaatggaggctgacaatcatgatcagtct

SEQ ID NO: 49551 - DNA, 201 bp, Homo sapiens
gaatccaagagcctgaaagtctcagctggttgcctcgtctgtctactttttttttttttttttttgccatagtacctcagtttatttggatattggccctyaaatggctcagaacggaaaatggaggctgacaatcatgatcagtctcataccctttggtacctggggattaggaatgaatgtatggcccaatactgaaga

SEQ ID NO: 49552 - DNA, 201 bp, Homo sapiens
atatatggtcacttggtattctattttttaaaaaatcataaaattttatatgaatgctctcaaaaaagcaacttacaagtgcttatataactaatatttawatcacaacattttaactctaacaccaggtgttacaattgacagatttcttgaatactacaataaacactttttaaatttaattagtattctgaggctcga

SEQ ID NO: 49553 - DNA, 201 bp, Homo sapiens
ttgccatagtacctcagtttatttggatattggcccttaaatggctcagaacggaaaatggaggctgacaatcatgatcagtctcataccctttggtaccyggggattaggaatgaatgtatggcccaatactgaagagagacatgcaggaaaatctatctatgtggctttacccacaggaaacatgtaatagtaggaaca

SEQ ID NO: 49554 - DNA, 201 bp, Homo sapiens
accctttggtacctggggattaggaatgaatgtatggcccaatactgaagagagacatgcaggaaaatctatctatgtggctttacccacaggaaacatgyaatagtaggaacacccttctttttcacttacagtgggcatatgccaatatggtaccaagaaactgatgaacacatcttgcaaacgtaagtaacagctgcc

SEQ ID NO: 49555 - DNA, 201 bp, Homo sapiens
tcttaagaccggggaaaagtctgggagagagaatcgtggagagactggagccagcgcgagtctgcgagtccgagtccgggcgcgccagagcagaggggcgycctcgctctgcctctcactcacttggtctgagccatcatggactctgcgtgctcctttgctgaagatttcacacccaaatttgcttcccaatatccaatc

SEQ ID NO: 49556 - DNA, 201 bp, Homo sapiens
atataaggaaaaagagaaggaggaggcagaagacaagaagaaaaacaaacaaacaaaaaacccaacaaattattgagagactcatcttccaagaactaagytcactgctttacatattttttctaaacttcaaaagtgctcaataaaatgctgcagtgctcctttcagagacagaaatgaatgctcacagaagtgaagtcc

SEQ ID NO: 49557 - DNA, 201 bp, Homo sapiens
tattgagtcccggtggataaagttagcatatcttgtttctcactcagcttaaatatatttgcctttcagaagagtaggtagtgaagattaacttgattgtyctgtagtatggtacagtaaagtgggcaatttttctacatctcttgagatcaaatgagggtagagggtggagataggtgctaaatttccaggcttgggtgg

SEQ ID NO: 49558 - DNA, 201 bp, Homo sapiens
tcaagattttgttgaaatgcttctaagtttagaactttgatcattacattttactattgagtcccggtggataaagttagcatatcttgtttctcactcascttaaatatatttgcctttcagaagagtaggtagtgaagattaacttgattgtcctgtagtatggtacagtaaagtgggcaatttttctacatctcttga

SEQ ID NO: 49559 - DNA, 201 bp, Homo sapiens
ccatgattggaaattcctgaggccctcatcaaaagccaagcagatgccagtgtcatgcttgtacagcctgcagaatactgagccaataaatcgtgttttctttataaattacccgtctcagttatttctctatagcaattcaagaatagtctaacacatccactttctattcaaatataaacttaatcattttcctcaaac

SEQ ID NO: 49560 - DNA, 201 bp, Homo sapiens
ttcaagattttgttgaaatgcttctaagtttagaactttgatcattacattttactattgagtcccggtggataaagttagcatatcttgtttctcactcmgcttaaatatatttgcctttcagaagagtaggtagtgaagattaacttgattgtcctgtagtatggtacagtaaagtgggcaatttttctacatctcttg

SEQ ID NO: 49561 - DNA, 201 bp, Homo sapiens
actaagggaaaacttttactcccttagaagctaatgataatctcacttatttcctttacatagtcttttcatctggaggcaaatggctcctataaaaaaaagtaaaaagggagggtctgttttgcaattgggatctactgggatgcatgtcatacttaaagtaccaaaaattcatggtagatgaataaaattaagtacttc

SEQ ID NO: 49562 - DNA, 201 bp, Homo sapiens
aatattatgttaaaatgctacatctaaattgcaaaattttaatttacccttttactaatcttcatcgtttgttacaagggaaaaacaacttttcttagccytattaatttttgttgatctttttaaaaagattgaatatctgaatgggtaaacaaaacacagcaaaaccatttgacaaggcaccatagatttttgccctct

SEQ ID NO: 49563 - DNA, 201 bp, Homo sapiens
tgattggagcaacatttttgtcccctgtccttcatctccattcaattaatgcctcagaaaaacaggaaactatcccctagatgatatgtagagctacttarttttggctgtattcagctactaagtctagatatgggggtagacacccaagtttcaaggcgtttgaccagtccctgattcttcagtgttttgggattccaa

SEQ ID NO: 49564 - DNA, 201 bp, Homo sapiens
tgtaccacatccattcagtgtttctggagacataaatggttaacttcatggtcaagaaaaaagtatctcttctttatatcattctaaaagaaatacaacamtttttccatatatgaatatacattttggacatccattgatatattctatgagttgagagcataggtttctgtctaatgaacaaaaaatcaggttaagtca

SEQ ID NO: 49565 - DNA, 201 bp, Homo sapiens
tgaattcccttagtcataaattcatttgaggacaattttcttcccccgataaaataaatgaaaagttacagaaattttcatgcagatttttaaaaaagtgyccccaccttcttccagtcagtgtgctcagaaggaggatccaggcccaaagacagtcagacagacctggacttttcctcatcgcgggctggagcagctgaa

SEQ ID NO: 49566 - DNA, 201 bp, Homo sapiens
agcttctagttgtaagaaagtagcagccccccacaccttgccaccaaataaagtgattatggacaagaatgaatccagtaattactgataatttttagttktattttctggatactgattattttaactcaagtctatttaaaagtgtcttcattgacattgcacttaaattatgaacatagctatcttatttttctcttt

SEQ ID NO: 49567 - DNA, 201 bp, Homo sapiens
tgaattcccttagtcataaattcatttgaggacaattttcttcccccgataaaataaatgaaaagttacagaaattttcatgcagatttttaaaaaagtgwccccaccttcttccagtcagtgtgctcagaaggaggatccaggcccaaagacagtcagacagacctggacttttcctcatcgcgggctggagcagctgaa

SEQ ID NO: 49568 - DNA, 201 bp, Homo sapiens
gcagaaattaagcaagaacatttttccctatgtatcagtttataccttctttatggataaagtaaaaagtttttactgaacaatttcaaatacttgatagytcaagtactggtgcttagatatctagtgaaatacaacttcccttcttgagtcctgactctaactataaattgtgactgcattccaaactaagagaagcac

SEQ ID NO: 49569 - DNA, 201 bp, Homo sapiens
aatgtctcaagttcctttgttttcacccctacataatgtaccacatccattcagtgtttctggagacataaatggttaacttcatggtcaagaaaaaagtwtctcttctttatatcattctaaaagaaatacaacactttttccatatatgaatatacattttggacatccattgatatattctatgagttgagagcatag

SEQ ID NO: 49570 - DNA, 201 bp, Homo sapiens
cttatactttcctctctaatatatctcctttgccacatacccaagaaattctttcatttgatttgtcatcagctcttggcaagtgtccagtggcggggcarcaaggggggaagtttctgtggctggaaaactctgctaattttctaacactgttgaaaacattaacatcctaatgtctctgagaaatcatgtcttaaataa

SEQ ID NO: 49571 - DNA, 201 bp, Homo sapiens
ttacatcttcctcctcctcctccttcctcctcctccccttcttcttcttcttcttcttcttcttcttcttcttcttcttcttcttcttcttcttcttcttyttccttcttctttgtcttcatctctgtctttgtcttcatcttctgctgcttctgctcctgttgttgttgttgtttcagggagaaatcgttttgtgtttct

SEQ ID NO: 49572 - DNA, 201 bp, Homo sapiens
gtcttaaataaatatggtcaaacttgtttacccatgtttccccaaattatttggggctgctactctaagatatttcaaaagctgtagggtacgcttgaggygtatataactatataatacattatgttgttagaaaaaaaaaagcttcaaaatataagtttaaaaaactcagaaagacatgaaaacaagtaaaatttcctt

SEQ ID NO: 49573 - DNA, 201 bp, Homo sapiens
tttgtaaatgcttcaaagattaaccagtcttccattctcattgggaagtattacttgattatctcctgtctgctttacttaggatatcagcctgaaaaacwctggcagcacttaaactacttatgagactgtaatcactaggatggggtggggctgggaatacgtttttggagacagagaatctgggttttcttatttagt

SEQ ID NO: 49574 - DNA, 201 bp, Homo sapiens
ttgaaactgtcagtcaactaaagagatatgtttgagtaagaaaaactgtctaatgcacattataaataccaaatcacttttgcaatgttacctacatgtakacttacatcttcctcctcctcctccttcctcctcctccccttcttcttcttcttcttcttcttcttcttcttcttcttcttcttcttcttcttcttcttc

SEQ ID NO: 49575 - DNA, 201 bp, Homo sapiens
atacagtgatctgaaatttacttcttgggtaattggaaaccaatttgttgttggtttgtcaaccaacatgttgacatgttgttacactgggaaaatatatytaaaagagattgactaaaccagtgttttcataactgtgttataaagaatgcatgtttctagagatagtagcattttatgaaaataagttctcatagtttg

SEQ ID NO: 49576 - DNA, 201 bp, Homo sapiens
ccgaagaagagttgggttctcaaaattgttgcgatttcattcacttctagaagttgagaagtaagtggaagcatagtgctagaagctcatactcactttcyttgtcttcctaattatatagccatccaagagtaacacttctcttcggtaataagatagttcagaatcttaaacatttttccaaataacatgcttagaggt

SEQ ID NO: 49577 - DNA, 201 bp, Homo sapiens
catttgaggaattcatacctacacatgtgtacactaacttgcagtttccaaaacttattgtatacataatctttaaaaatacactgaataaaccaatcagwttatttttagaactagttaaatcaatccagaagttctctgaaggagttaatgtgagcaaaaccatcaaatcaaggcttagagattttaccagatataaaa

SEQ ID NO: 49578 - DNA, 201 bp, Homo sapiens
tcctctctaatatatctcctttgccacatacccaagaaattctttcatttgatttgtcatcagctcttggcaagtgtccagtggcggggcagcaagggggsaagtttctgtggctggaaaactctgctaattttctaacactgttgaaaacattaacatcctaatgtctctgagaaatcatgtcttaaataaatatggtca

SEQ ID NO: 49579 - DNA, 201 bp, Homo sapiens
aagcgataattcaaaaagatgagattagtactggaggcaaaaatgagaaaagcagagtagtaaaataagtagtaagcacaatagattaagcatctaaatastcagatttaaactgatttttctcgagaacaagctatgtgattttaggtgcaatactttaatctctctgagtctctattcttacattttggatgaagaaat

SEQ ID NO: 49580 - DNA, 201 bp, Homo sapiens
tactcagatttaaactgatttttctcgagaacaagctatgtgattttaggtgcaatactttaatctctctgagtctctattcttacattttggatgaagarataatacctgctcaaatgactacatagcattggagtgatgttcaaataacactgtggtgccaaaacactttgagaggcatctattgcgtacattaattta

SEQ ID NO: 49581 - DNA, 201 bp, Homo sapiens
actttagaacagaagcttgagaaaggttccttaaagagatagtaatgctaatatatattgtcacttgtcttcagggtaaaaacgagggaaacatctagaaytgaatccctgtaaatggcgtaagaatcttaaactatcagaccctaggatgaagctgcatgacccacctagctccctagttatggtttgccccaaatataa

SEQ ID NO: 49582 - DNA, 201 bp, Homo sapiens
ttaatctgtgtggaaaagaaaggccattttctactgctgtgctgcaaaagaaattttttaaatttatagagcatagaagcagcaacatttctggaatccawgagcctgaaagtctcagctggttgcctcgtctgtctactttttttttttttttttttgccatagtacctcagtttatttggatattggcccttaaatggc

SEQ ID NO: 49583 - DNA, 21 bp, Homo sapiens
attgcttttgctacattgttg

SEQ ID NO: 49584 - DNA, 23 bp, Homo sapiens
aaattgcttttgctacattgtta

SEQ ID NO: 49585 - DNA, 22 bp, Homo sapiens
ctttcaaagcaatgtgagattc

SEQ ID NO: 49586 - DNA, 17 bp, Homo sapiens
cccgttggttccgaaag

SEQ ID NO: 49587 - DNA, 17 bp, Homo sapiens
cccgttggttccgaaaa

SEQ ID NO: 49588 - DNA, 24 bp, Homo sapiens
tgaatagccattagaaaaaactgt

SEQ ID NO: 49589 - DNA, 21 bp, Homo sapiens
ggatggtcttctctttgtcaa

SEQ ID NO: 49590 - DNA, 21 bp, Homo sapiens
ggatggtcttctctttgtcag

SEQ ID NO: 49591 - DNA, 19 bp, Homo sapiens
tttgatgccaacccatatg

SEQ ID NO: 49592 - DNA, 21 bp, Homo sapiens
catttgtatttcttctgggga

SEQ ID NO: 49593 - DNA, 21 bp, Homo sapiens
catttgtatttcttctggggt

SEQ ID NO: 49594 - DNA, 22 bp, Homo sapiens
tcctaagccagcctattctaaa

SEQ ID NO: 49595 - DNA, 20 bp, Homo sapiens
tcagctcatgatgtgtgatg

SEQ ID NO: 49596 - DNA, 21 bp, Homo sapiens
ctcagctcatgatgtgtgatt

SEQ ID NO: 49597 - DNA, 24 bp, Homo sapiens
cctgtatgcagcttaagttgataa

SEQ ID NO: 49598 - DNA, 20 bp, Homo sapiens
gcttcacatcacatacatcg

SEQ ID NO: 49599 - DNA, 21 bp, Homo sapiens
ggcttcacatcacatacatca

SEQ ID NO: 49600 - DNA, 18 bp, Homo sapiens
tccaattcctgcctcatg

SEQ ID NO: 49601 - DNA, 16 bp, Homo sapiens
cggctcgaggtttcat

SEQ ID NO: 49602 - DNA, 16 bp, Homo sapiens
cggctcgaggtttcac

SEQ ID NO: 49603 - DNA, 19 bp, Homo sapiens
actgggcctggagtgtagt

SEQ ID NO: 49604 - DNA, 20 bp, Homo sapiens
ctcctgaaagggttgaactc

SEQ ID NO: 49605 - DNA, 19 bp, Homo sapiens
tcctgaaagggttgaactg

SEQ ID NO: 49606 - DNA, 18 bp, Homo sapiens
caactcctgggctgaatg

SEQ ID NO: 49607 - DNA, 23 bp, Homo sapiens
acacattggagaaagacctattt

SEQ ID NO: 49608 - DNA, 22 bp, Homo sapiens
cacattggagaaagacctattg

SEQ ID NO: 49609 - DNA, 19 bp, Homo sapiens
gcaagcgagaaaactgtgt

SEQ ID NO: 49610 - DNA, 23 bp, Homo sapiens
tgagattttgaagacatctggta

SEQ ID NO: 49611 - DNA, 22 bp, Homo sapiens
gagattttgaagacatctggtg

SEQ ID NO: 49612 - DNA, 20 bp, Homo sapiens
ctgaatgcaagctgatgact

SEQ ID NO: 49613 - DNA, 24 bp, Homo sapiens
gaagttcttaccacactgactaca

SEQ ID NO: 49614 - DNA, 24 bp, Homo sapiens
gaagttcttaccacactgactacc

SEQ ID NO: 49615 - DNA, 26 bp, Homo sapiens
aataactgtgggaaaatacttaacac

SEQ ID NO: 49616 - DNA, 17 bp, Homo sapiens
gcagagcattgtgttcg

SEQ ID NO: 49617 - DNA, 18 bp, Homo sapiens
cgcagagcattgtgttct

SEQ ID NO: 49618 - DNA, 22 bp, Homo sapiens
ggtatctgcaaggatgagaaac

SEQ ID NO: 49619 - DNA, 23 bp, Homo sapiens
ccttttagggttttctgattatg

SEQ ID NO: 49620 - DNA, 23 bp, Homo sapiens
ccttttagggttttctgattatc

SEQ ID NO: 49621 - DNA, 21 bp, Homo sapiens
cagacgagaaaccagaatgat

SEQ ID NO: 49622 - DNA, 22 bp, Homo sapiens
tttgcaaagaacttgatttctt

SEQ ID NO: 49623 - DNA, 22 bp, Homo sapiens
tttgcaaagaacttgatttctc

SEQ ID NO: 49624 - DNA, 20 bp, Homo sapiens
tccagtgcagcatttaccta

SEQ ID NO: 49625 - DNA, 19 bp, Homo sapiens
ggcttctaccctctggaga

SEQ ID NO: 49626 - DNA, 18 bp, Homo sapiens
gcttctaccctctggagg

SEQ ID NO: 49627 - DNA, 21 bp, Homo sapiens
ccacttctggaaggttctgta

SEQ ID NO: 49628 - DNA, 18 bp, Homo sapiens
catccagaggaagcatga

SEQ ID NO: 49629 - DNA, 17 bp, Homo sapiens
atccagaggaagcatgg

SEQ ID NO: 49630 - DNA, 19 bp, Homo sapiens
ttgtgctgggagatctgag

SEQ ID NO: 49631 - DNA, 15 bp, Homo sapiens
gtgtggcggagcagt

SEQ ID NO: 49632 - DNA, 14 bp, Homo sapiens
tgtggcggagcagc

SEQ ID NO: 49633 - DNA, 16 bp, Homo sapiens
ccccggcgacctatag

SEQ ID NO: 49634 - DNA, 15 bp, Homo sapiens
tcacggtgctgtccg

SEQ ID NO: 49635 - DNA, 17 bp, Homo sapiens
cctcacggtgctgtcct

SEQ ID NO: 49636 - DNA, 18 bp, Homo sapiens
gctttgccctgcatttct

SEQ ID NO: 49637 - DNA, 16 bp, Homo sapiens
tgggaaattcaaggcg

SEQ ID NO: 49638 - DNA, 17 bp, Homo sapiens
ctgggaaattcaaggca

SEQ ID NO: 49639 - DNA, 26 bp, Homo sapiens
tttaagtcctgggtaaactaaataga

SEQ ID NO: 49640 - DNA, 22 bp, Homo sapiens
tgagtttgtattttccaaggac

SEQ ID NO: 49641 - DNA, 23 bp, Homo sapiens
atgagtttgtattttccaaggat

SEQ ID NO: 49642 - DNA, 24 bp, Homo sapiens
gctccatagaaagacaatttactg

SEQ ID NO: 49643 - DNA, 20 bp, Homo sapiens
ttgtgaagccctagatttcc

SEQ ID NO: 49644 - DNA, 19 bp, Homo sapiens
tgtgaagccctagatttcg

SEQ ID NO: 49645 - DNA, 19 bp, Homo sapiens
ttggcaaaggagaacacaa

SEQ ID NO: 49646 - DNA, 17 bp, Homo sapiens
aaactggtatgtgggcg

SEQ ID NO: 49647 - DNA, 18 bp, Homo sapiens
aaaactggtatgtgggcc

SEQ ID NO: 49648 - DNA, 19 bp, Homo sapiens
tccccctgactccttactt

SEQ ID NO: 49649 - DNA, 21 bp, Homo sapiens
tgttggctgagagataagcta

SEQ ID NO: 49650 - DNA, 20 bp, Homo sapiens
gttggctgagagataagctg

SEQ ID NO: 49651 - DNA, 21 bp, Homo sapiens
cgttgacatggactttgaagt

SEQ ID NO: 49652 - DNA, 24 bp, Homo sapiens
ttcttttaaaggattggtaaactc

SEQ ID NO: 49653 - DNA, 24 bp, Homo sapiens
ttcttttaaaggattggtaaactg

SEQ ID NO: 49654 - DNA, 22 bp, Homo sapiens
agagcagaacgaggttttattt

SEQ ID NO: 49655 - DNA, 17 bp, Homo sapiens
aactgaacgcaggcctc

SEQ ID NO: 49656 - DNA, 17 bp, Homo sapiens
aactgaacgcaggcctt

SEQ ID NO: 49657 - DNA, 22 bp, Homo sapiens
cattctgacctcaacaacttca

SEQ ID NO: 49658 - DNA, 21 bp, Homo sapiens
tgcagtcataaatctcatcag

SEQ ID NO: 49659 - DNA, 22 bp, Homo sapiens
ttgcagtcataaatctcatcat

SEQ ID NO: 49660 - DNA, 18 bp, Homo sapiens
agcaatgggcactcagtc

SEQ ID NO: 49661 - DNA, 16 bp, Homo sapiens
tgggtcagcccaacat

SEQ ID NO: 49662 - DNA, 16 bp, Homo sapiens
tgggtcagcccaacac

SEQ ID NO: 49663 - DNA, 23 bp, Homo sapiens
ttgaagaaggaatgatcactctt

SEQ ID NO: 49664 - DNA, 14 bp, Homo sapiens
cgcacttctccagc

SEQ ID NO: 49665 - DNA, 15 bp, Homo sapiens
ccgcacttctccagt

SEQ ID NO: 49666 - DNA, 20 bp, Homo sapiens
aggccataaagaggcagtac

SEQ ID NO: 49667 - DNA, 16 bp, Homo sapiens
tgggtcagcccaacat

SEQ ID NO: 49668 - DNA, 16 bp, Homo sapiens
tgggtcagcccaacac

SEQ ID NO: 49669 - DNA, 23 bp, Homo sapiens
ttgaagaaggaatgatcactctt

SEQ ID NO: 49670 - DNA, 21 bp, Homo sapiens
aattagcaacatcatccttgg

SEQ ID NO: 49671 - DNA, 21 bp, Homo sapiens
aattagcaacatcatccttgc

SEQ ID NO: 49672 - DNA, 22 bp, Homo sapiens
gccagctccatattgaagtaat

SEQ ID NO: 49673 - DNA, 17 bp, Homo sapiens
cacagtgaatggtgggg

SEQ ID NO: 49674 - DNA, 18 bp, Homo sapiens
tcacagtgaatggtggga

SEQ ID NO: 49675 - DNA, 18 bp, Homo sapiens
agctgggctgggtctagt

SEQ ID NO: 49676 - DNA, 14 bp, Homo sapiens
gccaactccatccg

SEQ ID NO: 49677 - DNA, 15 bp, Homo sapiens
ggccaactccatcca

SEQ ID NO: 49678 - DNA, 20 bp, Homo sapiens
catccgtcacctcagagatg

SEQ ID NO: 49679 - DNA, 20 bp, Homo sapiens
tacctgaaactctgacgcat

SEQ ID NO: 49680 - DNA, 19 bp, Homo sapiens
acctgaaactctgacgcac

SEQ ID NO: 49681 - DNA, 20 bp, Homo sapiens
tgtttccaggttcaatttca

SEQ ID NO: 49682 - DNA, 20 bp, Homo sapiens
acaatgtgaggatcttcatg

SEQ ID NO: 49683 - DNA, 21 bp, Homo sapiens
cacaatgtgaggatcttcata

SEQ ID NO: 49684 - DNA, 21 bp, Homo sapiens
cacccacattgtgtgcatata

SEQ ID NO: 49685 - DNA, 18 bp, Homo sapiens
caggcatgacattgaaac

SEQ ID NO: 49686 - DNA, 18 bp, Homo sapiens
caggcatgacattgaaag

SEQ ID NO: 49687 - DNA, 25 bp, Homo sapiens
cagaatgtagtctcgattcttcttc

SEQ ID NO: 49688 - DNA, 19 bp, Homo sapiens
cccaggctaagaacctgac

SEQ ID NO: 49689 - DNA, 19 bp, Homo sapiens
cccaggctaagaacctgat

SEQ ID NO: 49690 - DNA, 20 bp, Homo sapiens
caaagtgctgagcgtacttg

SEQ ID NO: 49691 - DNA, 19 bp, Homo sapiens
tggagatgttcacctggtc

SEQ ID NO: 49692 - DNA, 19 bp, Homo sapiens
tggagatgttcacctggtt

SEQ ID NO: 49693 - DNA, 23 bp, Homo sapiens
gacaggttgttgacattttacaa

SEQ ID NO: 49694 - DNA, 19 bp, Homo sapiens
agctcttccttcttcatca

SEQ ID NO: 49695 - DNA, 18 bp, Homo sapiens
gctcttccttcttcatcg

SEQ ID NO: 49696 - DNA, 25 bp, Homo sapiens
tgaactctaggaatcatttgaaaat

SEQ ID NO: 49697 - DNA, 19 bp, Homo sapiens
taggagggtgaaaagtgga

SEQ ID NO: 49698 - DNA, 17 bp, Homo sapiens
ggagggtgaaaagtggg

SEQ ID NO: 49699 - DNA, 16 bp, Homo sapiens
ggcagcgtgctcagac

SEQ ID NO: 49700 - DNA, 23 bp, Homo sapiens
atctttgccaatgattttattac

SEQ ID NO: 49701 - DNA, 24 bp, Homo sapiens
aatctttgccaatgattttattat

SEQ ID NO: 49702 - DNA, 21 bp, Homo sapiens
gaatccaaacgatccagatac

SEQ ID NO: 49703 - DNA, 18 bp, Homo sapiens
cccccttaccttggaaga

SEQ ID NO: 49704 - DNA, 17 bp, Homo sapiens
ccccttaccttggaagg

SEQ ID NO: 49705 - DNA, 19 bp, Homo sapiens
ggcagtcgctggagattat

SEQ ID NO: 49706 - DNA, 21 bp, Homo sapiens
agaaacaccttctgtgactga

SEQ ID NO: 49707 - DNA, 20 bp, Homo sapiens
gaaacaccttctgtgactgc

SEQ ID NO: 49708 - DNA, 20 bp, Homo sapiens
cccaacatcctcatctgtct

SEQ ID NO: 49709 - DNA, 18 bp, Homo sapiens
cctttgcattccttagca

SEQ ID NO: 49710 - DNA, 18 bp, Homo sapiens
cctttgcattccttagcg

SEQ ID NO: 49711 - DNA, 17 bp, Homo sapiens
gccagaggccaagatga

SEQ ID NO: 49712 - DNA, 16 bp, Homo sapiens
cgtgtccttcccaacg

SEQ ID NO: 49713 - DNA, 17 bp, Homo sapiens
tcgtgtccttcccaaca

SEQ ID NO: 49714 - DNA, 20 bp, Homo sapiens
ggagaagaccctggaattct

SEQ ID NO: 49715 - DNA, 13 bp, Homo sapiens
ggctgcgattccg

SEQ ID NO: 49716 - DNA, 15 bp, Homo sapiens
gtggctgcgattcca

SEQ ID NO: 49717 - DNA, 18 bp, Homo sapiens
gcaatgggcatgatttca

SEQ ID NO: 49718 - DNA, 19 bp, Homo sapiens
ggcgatattggtgagaaac

SEQ ID NO: 49719 - DNA, 19 bp, Homo sapiens
ggcgatattggtgagaaat

SEQ ID NO: 49720 - DNA, 18 bp, Homo sapiens
ctccttcctcccactgtg

SEQ ID NO: 49721 - DNA, 18 bp, Homo sapiens
ttttgtcccagtgctgag

SEQ ID NO: 49722 - DNA, 18 bp, Homo sapiens
ttttgtcccagtgctgaa

SEQ ID NO: 49723 - DNA, 15 bp, Homo sapiens
tctccggccgcatac

SEQ ID NO: 49724 - DNA, 22 bp, Homo sapiens
acaaaagaatgtcctttcagac

SEQ ID NO: 49725 - DNA, 22 bp, Homo sapiens
acaaaagaatgtcctttcagag

SEQ ID NO: 49726 - DNA, 21 bp, Homo sapiens
tcctcattggaatggatttat

SEQ ID NO: 49727 - DNA, 19 bp, Homo sapiens
tgagagttggatctggcaa

SEQ ID NO: 49728 - DNA, 19 bp, Homo sapiens
tgagagttggatctggcat

SEQ ID NO: 49729 - DNA, 21 bp, Homo sapiens
cccaggaacccatatttagaa

SEQ ID NO: 49730 - DNA, 13 bp, Homo sapiens
aggcggagacagc

SEQ ID NO: 49731 - DNA, 15 bp, Homo sapiens
caaggcggagacagt

SEQ ID NO: 49732 - DNA, 18 bp, Homo sapiens
gggcagcaggaaagatct

SEQ ID NO: 49733 - DNA, 17 bp, Homo sapiens
actccactgggagaggg

SEQ ID NO: 49734 - DNA, 17 bp, Homo sapiens
actccactgggagaggc

SEQ ID NO: 49735 - DNA, 19 bp, Homo sapiens
ccacagccacatggtatgt

SEQ ID NO: 49736 - DNA, 21 bp, Homo sapiens
ctagcattgaactgaatgagc

SEQ ID NO: 49737 - DNA, 21 bp, Homo sapiens
ctagcattgaactgaatgagg

SEQ ID NO: 49738 - DNA, 17 bp, Homo sapiens
cagcctgcgatgatgat

SEQ ID NO: 49739 - DNA, 15 bp, Homo sapiens
ggacctgctttggcg

SEQ ID NO: 49740 - DNA, 16 bp, Homo sapiens
tggacctgctttggca

SEQ ID NO: 49741 - DNA, 18 bp, Homo sapiens
cctcggtgggttttcaag

SEQ ID NO: 49742 - DNA, 17 bp, Homo sapiens
cgtccaccttctccaag

SEQ ID NO: 49743 - DNA, 17 bp, Homo sapiens
cgtccaccttctccaac

SEQ ID NO: 49744 - DNA, 20 bp, Homo sapiens
ccagcgttagcatctcatac

SEQ ID NO: 49745 - DNA, 16 bp, Homo sapiens
cctccacttcctgtat

SEQ ID NO: 49746 - DNA, 16 bp, Homo sapiens
cctccacttcctgtac

SEQ ID NO: 49747 - DNA, 24 bp, Homo sapiens
cccatcccacactttattttatac

SEQ ID NO: 49748 - DNA, 21 bp, Homo sapiens
tgcctatgaattgtcaacatc

SEQ ID NO: 49749 - DNA, 21 bp, Homo sapiens
tgcctatgaattgtcaacatt

SEQ ID NO: 49750 - DNA, 20 bp, Homo sapiens
acttctggccagcaataaat

SEQ ID NO: 49751 - DNA, 24 bp, Homo sapiens
tttaacagattctggaagcatagt

SEQ ID NO: 49752 - DNA, 23 bp, Homo sapiens
ttaacagattctggaagcataga

SEQ ID NO: 49753 - DNA, 24 bp, Homo sapiens
agaggaatccaaagacaaagttat

SEQ ID NO: 49754 - DNA, 17 bp, Homo sapiens
cctgggatttggggatt

SEQ ID NO: 49755 - DNA, 17 bp, Homo sapiens
cctgggatttggggatc

SEQ ID NO: 49756 - DNA, 20 bp, Homo sapiens
tgtgccgaagtgaagaagtc

SEQ ID NO: 49757 - DNA, 19 bp, Homo sapiens
tgtggcttcttttcagagc

SEQ ID NO: 49758 - DNA, 19 bp, Homo sapiens
tgtggcttcttttcagagg

SEQ ID NO: 49759 - DNA, 20 bp, Homo sapiens
ggtaacaggcacggaagtat

SEQ ID NO: 49760 - DNA, 19 bp, Homo sapiens
ctcctcctgcagatcactc

SEQ ID NO: 49761 - DNA, 18 bp, Homo sapiens
tcctcctgcagatcactg

SEQ ID NO: 49762 - DNA, 20 bp, Homo sapiens
ccaagaagccagctcattta

SEQ ID NO: 49763 - DNA, 17 bp, Homo sapiens
cgactcctcctcagccc

SEQ ID NO: 49764 - DNA, 17 bp, Homo sapiens
cgactcctcctcagcct

SEQ ID NO: 49765 - DNA, 16 bp, Homo sapiens
tgcagccacgcagaaa

SEQ ID NO: 49766 - DNA, 24 bp, Homo sapiens
caaagcactttcatgtacattatt

SEQ ID NO: 49767 - DNA, 24 bp, Homo sapiens
caaagcactttcatgtacattatc

SEQ ID NO: 49768 - DNA, 22 bp, Homo sapiens
cctaagcccagatttctactct

SEQ ID NO: 49769 - DNA, 20 bp, Homo sapiens
cgagacttcctgctacgttt

SEQ ID NO: 49770 - DNA, 20 bp, Homo sapiens
cgagacttcctgctacgttg

SEQ ID NO: 49771 - DNA, 23 bp, Homo sapiens
cccattacctggcttagtatctg

SEQ ID NO: 49772 - DNA, 18 bp, Homo sapiens
gaggatcctgaactccaa

SEQ ID NO: 49773 - DNA, 18 bp, Homo sapiens
gaggatcctgaactccag

SEQ ID NO: 49774 - DNA, 20 bp, Homo sapiens
cgaggaagaggactgaatga

SEQ ID NO: 49775 - DNA, 17 bp, Homo sapiens
ctgggaagcttctggac

SEQ ID NO: 49776 - DNA, 17 bp, Homo sapiens
ctgggaagcttctggaa

SEQ ID NO: 49777 - DNA, 23 bp, Homo sapiens
ctttaaagcctgattcttgacat

SEQ ID NO: 49778 - DNA, 20 bp, Homo sapiens
ggaagtgacaacacaaaacc

SEQ ID NO: 49779 - DNA, 21 bp, Homo sapiens
cggaagtgacaacacaaaact

SEQ ID NO: 49780 - DNA, 17 bp, Homo sapiens
ccgcccaggattctcta

SEQ ID NO: 49781 - DNA, 22 bp, Homo sapiens
cctggaactttgattgtgatac

SEQ ID NO: 49782 - DNA, 22 bp, Homo sapiens
cctggaactttgattgtgatat

SEQ ID NO: 49783 - DNA, 20 bp, Homo sapiens
tctcccgccttactctgtta

SEQ ID NO: 49784 - DNA, 18 bp, Homo sapiens
aaacgcagggattggtta

SEQ ID NO: 49785 - DNA, 17 bp, Homo sapiens
aacgcagggattggttc

SEQ ID NO: 49786 - DNA, 21 bp, Homo sapiens
catgtgcctctcttggtatct

SEQ ID NO: 49787 - DNA, 20 bp, Homo sapiens
ggtgagatagtccagaaagc

SEQ ID NO: 49788 - DNA, 21 bp, Homo sapiens
gggtgagatagtccagaaagt

SEQ ID NO: 49789 - DNA, 16 bp, Homo sapiens
gggccgaggtcatctt

SEQ ID NO: 49790 - DNA, 16 bp, Homo sapiens
gccccatcttgctgat

SEQ ID NO: 49791 - DNA, 16 bp, Homo sapiens
gccccatcttgctgac

SEQ ID NO: 49792 - DNA, 21 bp, Homo sapiens
ccgggtttttgagaagtagat

SEQ ID NO: 49793 - DNA, 14 bp, Homo sapiens
ccgcctcggtcgtt

SEQ ID NO: 49794 - DNA, 14 bp, Homo sapiens
ccgcctcggtcgtc

SEQ ID NO: 49795 - DNA, 21 bp, Homo sapiens
gcaatcgtggaagatcagata

SEQ ID NO: 49796 - DNA, 18 bp, Homo sapiens
ccagcataggtgcaaacc

SEQ ID NO: 49797 - DNA, 19 bp, Homo sapiens
accagcataggtgcaaact

SEQ ID NO: 49798 - DNA, 22 bp, Homo sapiens
gagtactgcctgttcctgatac

SEQ ID NO: 49799 - DNA, 23 bp, Homo sapiens
catttttcaactacctttctgtg

SEQ ID NO: 49800 - DNA, 24 bp, Homo sapiens
tcatttttcaactacctttctgtt

SEQ ID NO: 49801 - DNA, 21 bp, Homo sapiens
ggtgaggttgatgaaaagaga

SEQ ID NO: 49802 - DNA, 21 bp, Homo sapiens
agggtttctcctctgtatgac

SEQ ID NO: 49803 - DNA, 21 bp, Homo sapiens
agggtttctcctctgtatgag

SEQ ID NO: 49804 - DNA, 22 bp, Homo sapiens
gaatggccagttaaaagaatct

SEQ ID NO: 49805 - DNA, 19 bp, Homo sapiens
gctctctagctgtgatgcc

SEQ ID NO: 49806 - DNA, 20 bp, Homo sapiens
agctctctagctgtgatgct

SEQ ID NO: 49807 - DNA, 19 bp, Homo sapiens
tgaggaatgggttgatgac

SEQ ID NO: 49808 - DNA, 21 bp, Homo sapiens
cattgctttcctaggtgatat

SEQ ID NO: 49809 - DNA, 21 bp, Homo sapiens
cattgctttcctaggtgatag

SEQ ID NO: 49810 - DNA, 22 bp, Homo sapiens
ttcttcagggaacatttgtatg

SEQ ID NO: 49811 - DNA, 19 bp, Homo sapiens
tttgagtgttgctggaaca

SEQ ID NO: 49812 - DNA, 18 bp, Homo sapiens
ttgagtgttgctggaacg

SEQ ID NO: 49813 - DNA, 17 bp, Homo sapiens
tcgcctccctcactgac

SEQ ID NO: 49814 - DNA, 18 bp, Homo sapiens
ctcggatggtgttggtac

SEQ ID NO: 49815 - DNA, 18 bp, Homo sapiens
ctcggatggtgttggtaa

SEQ ID NO: 49816 - DNA, 22 bp, Homo sapiens
tgtggtacagcagtcactaaga

SEQ ID NO: 49817 - DNA, 18 bp, Homo sapiens
ctgtacagcccctgaaag

SEQ ID NO: 49818 - DNA, 18 bp, Homo sapiens
ctgtacagcccctgaaac

SEQ ID NO: 49819 - DNA, 23 bp, Homo sapiens
agcagtcctgagttctttaagag

SEQ ID NO: 49820 - DNA, 18 bp, Homo sapiens
caggcggaaaactctctg

SEQ ID NO: 49821 - DNA, 19 bp, Homo sapiens
tcaggcggaaaactctcta

SEQ ID NO: 49822 - DNA, 24 bp, Homo sapiens
tcaaactctcctcagatgttacag

SEQ ID NO: 49823 - DNA, 20 bp, Homo sapiens
gggtatcacccttggataaa

SEQ ID NO: 49824 - DNA, 20 bp, Homo sapiens
gggtatcacccttggataag

SEQ ID NO: 49825 - DNA, 21 bp, Homo sapiens
tcccagactgctttgtagatg

SEQ ID NO: 49826 - DNA, 23 bp, Homo sapiens
tttatttttcagcaacacttgat

SEQ ID NO: 49827 - DNA, 23 bp, Homo sapiens
tttatttttcagcaacacttgac

SEQ ID NO: 49828 - DNA, 21 bp, Homo sapiens
ggatgtcctgacagaagaaag

SEQ ID NO: 49829 - DNA, 23 bp, Homo sapiens
aaagtgctgggattatagtcata

SEQ ID NO: 49830 - DNA, 22 bp, Homo sapiens
aagtgctgggattatagtcatg

SEQ ID NO: 49831 - DNA, 23 bp, Homo sapiens
caaatactcagcaaccaaaagtc

SEQ ID NO: 49832 - DNA, 19 bp, Homo sapiens
tgtggcttcttttcagagc

SEQ ID NO: 49833 - DNA, 19 bp, Homo sapiens
tgtggcttcttttcagagg

SEQ ID NO: 49834 - DNA, 20 bp, Homo sapiens
ggtaacaggcacggaagtat

SEQ ID NO: 49835 - DNA, 22 bp, Homo sapiens
tgaaaactcagtccaagtccta

SEQ ID NO: 49836 - DNA, 21 bp, Homo sapiens
gaaaactcagtccaagtcctc

SEQ ID NO: 49837 - DNA, 20 bp, Homo sapiens
ccttattgcccgtttaacat

SEQ ID NO: 49838 - DNA, 21 bp, Homo sapiens
aatgtggacactgaagagaca

SEQ ID NO: 49839 - DNA, 22 bp, Homo sapiens
caatgtggacactgaagagact

SEQ ID NO: 49840 - DNA, 21 bp, Homo sapiens
catcacagggcagagttttag

SEQ ID NO: 49841 - DNA, 18 bp, Homo sapiens
atgctgcctgagtcacac

SEQ ID NO: 49842 - DNA, 18 bp, Homo sapiens
atgctgcctgagtcacat

SEQ ID NO: 49843 - DNA, 24 bp, Homo sapiens
tgttcattcaacaagtctttattg

SEQ ID NO: 49844 - DNA, 14 bp, Homo sapiens
gcccactgtcccca

SEQ ID NO: 49845 - DNA, 13 bp, Homo sapiens
cccactgtccccg

SEQ ID NO: 49846 - DNA, 18 bp, Homo sapiens
cagagccccacagtcttt

SEQ ID NO: 49847 - DNA, 17 bp, Homo sapiens
ggtccttgagggaaacg

SEQ ID NO: 49848 - DNA, 18 bp, Homo sapiens
aggtccttgagggaaaca

SEQ ID NO: 49849 - DNA, 19 bp, Homo sapiens
tccacctatccgcctctag

SEQ ID NO: 49850 - DNA, 17 bp, Homo sapiens
gcatcgcatccaagatg

SEQ ID NO: 49851 - DNA, 19 bp, Homo sapiens
gagcatcgcatccaagata

SEQ ID NO: 49852 - DNA, 17 bp, Homo sapiens
cctgggaggctgatgac

SEQ ID NO: 49853 - DNA, 20 bp, Homo sapiens
ctcctgaaagggttgaactc

SEQ ID NO: 49854 - DNA, 19 bp, Homo sapiens
tcctgaaagggttgaactg

SEQ ID NO: 49855 - DNA, 18 bp, Homo sapiens
caactcctgggctgaatg

SEQ ID NO: 49856 - DNA, 24 bp, Homo sapiens
aactaaaaatcagtgagatgagtg

SEQ ID NO: 49857 - DNA, 25 bp, Homo sapiens
caactaaaaatcagtgagatgagta

SEQ ID NO: 49858 - DNA, 24 bp, Homo sapiens
cacctgactcactcttctttactt

SEQ ID NO: 49859 - DNA, 18 bp, Homo sapiens
cacctgtgaccagcagct

SEQ ID NO: 49860 - DNA, 16 bp, Homo sapiens
cctgtgaccagcagcg

SEQ ID NO: 49861 - DNA, 21 bp, Homo sapiens
caatctggaaggaacatcaag

SEQ ID NO: 49862 - DNA, 17 bp, Homo sapiens
gggcagtaggctgactt

SEQ ID NO: 49863 - DNA, 17 bp, Homo sapiens
gggcagtaggctgactg

SEQ ID NO: 49864 - DNA, 16 bp, Homo sapiens
gccggagctcctgttt

SEQ ID NO: 49865 - DNA, 24 bp, Homo sapiens
actgaaagcattttaatggactac

SEQ ID NO: 49866 - DNA, 24 bp, Homo sapiens
actgaaagcattttaatggactat

SEQ ID NO: 49867 - DNA, 24 bp, Homo sapiens
tcgtttcattttcatcattgtata

SEQ ID NO: 49868 - DNA, 19 bp, Homo sapiens
ctcctcctgcagatcactc

SEQ ID NO: 49869 - DNA, 18 bp, Homo sapiens
tcctcctgcagatcactg

SEQ ID NO: 49870 - DNA, 20 bp, Homo sapiens
ccaagaagccagctcattta

SEQ ID NO: 49871 - DNA, 16 bp, Homo sapiens
ctgagacagcagaggc

SEQ ID NO: 49872 - DNA, 17 bp, Homo sapiens
tctgagacagcagaggt

SEQ ID NO: 49873 - DNA, 20 bp, Homo sapiens
gcccaggctctagacactaa

SEQ ID NO: 49874 - DNA, 18 bp, Homo sapiens
cctggacaagctcattcg

SEQ ID NO: 49875 - DNA, 19 bp, Homo sapiens
tcctggacaagctcattca

SEQ ID NO: 49876 - DNA, 17 bp, Homo sapiens
cctgggtggccactcta

SEQ ID NO: 49877 - DNA, 15 bp, Homo sapiens
gctggttcctggggg

SEQ ID NO: 49878 - DNA, 15 bp, Homo sapiens
gctggttcctgggga

SEQ ID NO: 49879 - DNA, 20 bp, Homo sapiens
cccaccatcaacaggtactt

SEQ ID NO: 49880 - DNA, 26 bp, Homo sapiens
aactataatgatagctgctgttagtt

SEQ ID NO: 49881 - DNA, 26 bp, Homo sapiens
aactataatgatagctgctgttagtc

SEQ ID NO: 49882 - DNA, 21 bp, Homo sapiens
ttcacaacaaaggcagagtaa

SEQ ID NO: 49883 - DNA, 18 bp, Homo sapiens
aggcctggaagaacatct

SEQ ID NO: 49884 - DNA, 16 bp, Homo sapiens
gcctggaagaacatcc

SEQ ID NO: 49885 - DNA, 19 bp, Homo sapiens
gggcctcctacctgtcata

SEQ ID NO: 49886 - DNA, 14 bp, Homo sapiens
gcctccagccgcta

SEQ ID NO: 49887 - DNA, 13 bp, Homo sapiens
cctccagccgctg

SEQ ID NO: 49888 - DNA, 19 bp, Homo sapiens
cggtctttgctggtactgc

SEQ ID NO: 49889 - DNA, 19 bp, Homo sapiens
tccttttcaaagccaacaa

SEQ ID NO: 49890 - DNA, 19 bp, Homo sapiens
tccttttcaaagccaacac

SEQ ID NO: 49891 - DNA, 27 bp, Homo sapiens
tttctaaccattttaatacaggtcata

SEQ ID NO: 49892 - DNA, 15 bp, Homo sapiens
ggatgccccaagggt

SEQ ID NO: 49893 - DNA, 15 bp, Homo sapiens
ggatgccccaaggga

SEQ ID NO: 49894 - DNA, 22 bp, Homo sapiens
cacttcaggtgtgtcaacaatg

SEQ ID NO: 49895 - DNA, 19 bp, Homo sapiens
tctttcaaaaaccactgcc

SEQ ID NO: 49896 - DNA, 21 bp, Homo sapiens
actctttcaaaaaccactgct

SEQ ID NO: 49897 - DNA, 22 bp, Homo sapiens
agggaaactgcatttcttaatc

SEQ ID NO: 49898 - DNA, 14 bp, Homo sapiens
cagccccacgtgcc

SEQ ID NO: 49899 - DNA, 14 bp, Homo sapiens
cagccccacgtgca

SEQ ID NO: 49900 - DNA, 20 bp, Homo sapiens
gatgctgatggaacaagtga

SEQ ID NO: 49901 - DNA, 18 bp, Homo sapiens
cacccatctgaagagcac

SEQ ID NO: 49902 - DNA, 18 bp, Homo sapiens
cacccatctgaagagcat

SEQ ID NO: 49903 - DNA, 19 bp, Homo sapiens
ggctttggttgctttctct

SEQ ID NO: 49904 - DNA, 20 bp, Homo sapiens
gaagatggagaaatgcagct

SEQ ID NO: 49905 - DNA, 18 bp, Homo sapiens
agatggagaaatgcagcc

SEQ ID NO: 49906 - DNA, 17 bp, Homo sapiens
tggctgccttgagtcag

SEQ ID NO: 49907 - DNA, 18 bp, Homo sapiens
ccctccaggttgttacca

SEQ ID NO: 49908 - DNA, 17 bp, Homo sapiens
cctccaggttgttaccg

SEQ ID NO: 49909 - DNA, 22 bp, Homo sapiens
agactgcagcaaaactctgata

SEQ ID NO: 49910 - DNA, 21 bp, Homo sapiens
tgatcctttttaatccaggtt

SEQ ID NO: 49911 - DNA, 21 bp, Homo sapiens
tgatcctttttaatccaggtc

SEQ ID NO: 49912 - DNA, 19 bp, Homo sapiens
tgggctcagctgaactcta

SEQ ID NO: 49913 - DNA, 14 bp, Homo sapiens
gcggtctccatgcc

SEQ ID NO: 49914 - DNA, 14 bp, Homo sapiens
gcggtctccatgcg

SEQ ID NO: 49915 - DNA, 17 bp, Homo sapiens
gccaggtcccatttgag

SEQ ID NO: 49916 - DNA, 16 bp, Homo sapiens
ctcccgcttctggaac

SEQ ID NO: 49917 - DNA, 16 bp, Homo sapiens
ctcccgcttctggaag

SEQ ID NO: 49918 - DNA, 22 bp, Homo sapiens
aatcacgggattttctttagag

SEQ ID NO: 49919 - DNA, 20 bp, Homo sapiens
aagactttttccaggaatgc

SEQ ID NO: 49920 - DNA, 21 bp, Homo sapiens
gaagactttttccaggaatgt

SEQ ID NO: 49921 - DNA, 24 bp, Homo sapiens
ttcttaaagggtcatgaaacttac

SEQ ID NO: 49922 - DNA, 15 bp, Homo sapiens
gccgtgaactcgcag

SEQ ID NO: 49923 - DNA, 15 bp, Homo sapiens
gccgtgaactcgcat

SEQ ID NO: 49924 - DNA, 18 bp, Homo sapiens
gggtgtcaccaggaagag

SEQ ID NO: 49925 - DNA, 22 bp, Homo sapiens
cttctgggctttaaaaagacta

SEQ ID NO: 49926 - DNA, 21 bp, Homo sapiens
ttctgggctttaaaaagactt

SEQ ID NO: 49927 - DNA, 25 bp, Homo sapiens
aaatggtcaggtaattatgttatca

SEQ ID NO: 49928 - DNA, 19 bp, Homo sapiens
tggtgagactccagggtag

SEQ ID NO: 49929 - DNA, 19 bp, Homo sapiens
tggtgagactccagggtac

SEQ ID NO: 49930 - DNA, 21 bp, Homo sapiens
tcaaagccttgtgacattcta

SEQ ID NO: 49931 - DNA, 17 bp, Homo sapiens
ccatgacctgctcaacg

SEQ ID NO: 49932 - DNA, 17 bp, Homo sapiens
ccatgacctgctcaaca

SEQ ID NO: 49933 - DNA, 19 bp, Homo sapiens
ttgctgagcctgaactctg

SEQ ID NO: 49934 - DNA, 15 bp, Homo sapiens
gcgtcgctgtcgagg

SEQ ID NO: 49935 - DNA, 15 bp, Homo sapiens
gcgtcgctgtcgagc

SEQ ID NO: 49936 - DNA, 21 bp, Homo sapiens
gcttccactccttgaggtatt

SEQ ID NO: 49937 - DNA, 16 bp, Homo sapiens
agcctctcctggaccg

SEQ ID NO: 49938 - DNA, 17 bp, Homo sapiens
gagcctctcctggacca

SEQ ID NO: 49939 - DNA, 21 bp, Homo sapiens
agatccaaaggagaaacacaa

SEQ ID NO: 49940 - DNA, 16 bp, Homo sapiens
tcgggcttgcacaaag

SEQ ID NO: 49941 - DNA, 16 bp, Homo sapiens
tcgggcttgcacaaat

SEQ ID NO: 49942 - DNA, 16 bp, Homo sapiens
ggcggcctttctgagt

SEQ ID NO: 49943 - DNA, 17 bp, Homo sapiens
ggggttgatgtgggatc

SEQ ID NO: 49944 - DNA, 18 bp, Homo sapiens
tggggttgatgtgggata

SEQ ID NO: 49945 - DNA, 21 bp, Homo sapiens
aactccccaaaacaaagatct

SEQ ID NO: 49946 - DNA, 17 bp, Homo sapiens
gctgtgacgcttgtcaa

SEQ ID NO: 49947 - DNA, 17 bp, Homo sapiens
gctgtgacgcttgtcag

SEQ ID NO: 49948 - DNA, 16 bp, Homo sapiens
gatctgcgccctggac

SEQ ID NO: 49949 - DNA, 17 bp, Homo sapiens
cactgctgagccctgag

SEQ ID NO: 49950 - DNA, 17 bp, Homo sapiens
cactgctgagccctgac

SEQ ID NO: 49951 - DNA, 21 bp, Homo sapiens
cacgtttcgtctgcttttact

SEQ ID NO: 49952 - DNA, 18 bp, Homo sapiens
tgactcaactcccaaggg

SEQ ID NO: 49953 - DNA, 19 bp, Homo sapiens
ctgactcaactcccaagga

SEQ ID NO: 49954 - DNA, 19 bp, Homo sapiens
cggttctgctgtgagtgat

SEQ ID NO: 49955 - DNA, 25 bp, Homo sapiens
cagtgaagcctttattgtaagtact

SEQ ID NO: 49956 - DNA, 24 bp, Homo sapiens
agtgaagcctttattgtaagtacc

SEQ ID NO: 49957 - DNA, 23 bp, Homo sapiens
cagcgttgagtctttctttactt

SEQ ID NO: 49958 - DNA, 21 bp, Homo sapiens
aatattctcccagcattgttc

SEQ ID NO: 49959 - DNA, 21 bp, Homo sapiens
aatattctcccagcattgttt

SEQ ID NO: 49960 - DNA, 25 bp, Homo sapiens
gttttggagtcagaagattgtatta

SEQ ID NO: 49961 - DNA, 20 bp, Homo sapiens
agcagcactgtacctgtctg

SEQ ID NO: 49962 - DNA, 22 bp, Homo sapiens
gtagcagcactgtacctgtctc

SEQ ID NO: 49963 - DNA, 19 bp, Homo sapiens
tggctttgcactttcacat

SEQ ID NO: 49964 - DNA, 24 bp, Homo sapiens
agattctggtcctcttattgatac

SEQ ID NO: 49965 - DNA, 24 bp, Homo sapiens
agattctggtcctcttattgatat

SEQ ID NO: 49966 - DNA, 27 bp, Homo sapiens
aaaaagttcttgacaagttattatgag

SEQ ID NO: 49967 - DNA, 13 bp, Homo sapiens
cccgtccgcgcag

SEQ ID NO: 49968 - DNA, 13 bp, Homo sapiens
cccgtccgcgcat

SEQ ID NO: 49969 - DNA, 18 bp, Homo sapiens
tccggcatgttcatctct

SEQ ID NO: 49970 - DNA, 20 bp, Homo sapiens
agaatttggccacaaagagt

SEQ ID NO: 49971 - DNA, 18 bp, Homo sapiens
aatttggccacaaagagc

SEQ ID NO: 49972 - DNA, 16 bp, Homo sapiens
ccccgccagacatctt

SEQ ID NO: 49973 - DNA, 18 bp, Homo sapiens
cacagagcaggaagagca

SEQ ID NO: 49974 - DNA, 19 bp, Homo sapiens
tcacagagcaggaagagct

SEQ ID NO: 49975 - DNA, 23 bp, Homo sapiens
caggaagaagtttcatctgtgat

SEQ ID NO: 49976 - DNA, 19 bp, Homo sapiens
gacatcacagggatgaagg

SEQ ID NO: 49977 - DNA, 20 bp, Homo sapiens
tgacatcacagggatgaaga

SEQ ID NO: 49978 - DNA, 25 bp, Homo sapiens
aaggatgtgtcttgaatatgtatgt

SEQ ID NO: 49979 - DNA, 15 bp, Homo sapiens
gcggcaccacctgac

SEQ ID NO: 49980 - DNA, 15 bp, Homo sapiens
gcggcaccacctgat

SEQ ID NO: 49981 - DNA, 23 bp, Homo sapiens
cggatttcctagcttctcaacta

SEQ ID NO: 49982 - DNA, 14 bp, Homo sapiens
gtggtgggggagca

SEQ ID NO: 49983 - DNA, 13 bp, Homo sapiens
tggtgggggagcg

SEQ ID NO: 49984 - DNA, 18 bp, Homo sapiens
gcagcctagggtgaacat

SEQ ID NO: 49985 - DNA, 20 bp, Homo sapiens
agttttccccttgatcatac

SEQ ID NO: 49986 - DNA, 20 bp, Homo sapiens
agttttccccttgatcatat

SEQ ID NO: 49987 - DNA, 20 bp, Homo sapiens
ctgtttgggaccaagaattc

SEQ ID NO: 49988 - DNA, 24 bp, Homo sapiens
gtgcttccactttaaatttcttat

SEQ ID NO: 49989 - DNA, 24 bp, Homo sapiens
gtgcttccactttaaatttcttac

SEQ ID NO: 49990 - DNA, 21 bp, Homo sapiens
gccaatgtcacattcactgta

SEQ ID NO: 49991 - DNA, 18 bp, Homo sapiens
agctcattcgccacatac

SEQ ID NO: 49992 - DNA, 18 bp, Homo sapiens
agctcattcgccacataa

SEQ ID NO: 49993 - DNA, 24 bp, Homo sapiens
gttttccttgtttcagatttagtg

SEQ ID NO: 49994 - DNA, 24 bp, Homo sapiens
gatgcaggaaataagacaataata

SEQ ID NO: 49995 - DNA, 22 bp, Homo sapiens
tgcaggaaataagacaataatg

SEQ ID NO: 49996 - DNA, 25 bp, Homo sapiens
agaaagtccaataaaaatctgaact

SEQ ID NO: 49997 - DNA, 18 bp, Homo sapiens
gctttggtcgcacagtgt

SEQ ID NO: 49998 - DNA, 17 bp, Homo sapiens
ctttggtcgcacagtgc

SEQ ID NO: 49999 - DNA, 22 bp, Homo sapiens
cacaaatggaaaggtaaatgac

SEQ ID NO: 50000 - DNA, 16 bp, Homo sapiens
ggatccgaccgttgag

SEQ ID NO: 50001 - DNA, 16 bp, Homo sapiens
ggatccgaccgttgaa

SEQ ID NO: 50002 - DNA, 25 bp, Homo sapiens
tcattttgaactcattttttctaga

SEQ ID NO: 50003 - DNA, 18 bp, Homo sapiens
ccaggtccgaggatcaac

SEQ ID NO: 50004 - DNA, 18 bp, Homo sapiens
ccaggtccgaggatcaat

SEQ ID NO: 50005 - DNA, 18 bp, Homo sapiens
caagccctcatttcacca

SEQ ID NO: 50006 - DNA, 18 bp, Homo sapiens
tgaccggcttgtaggact

SEQ ID NO: 50007 - DNA, 17 bp, Homo sapiens
gaccggcttgtaggacg

SEQ ID NO: 50008 - DNA, 20 bp, Homo sapiens
ccttatcacccctttctcag

SEQ ID NO: 50009 - DNA, 22 bp, Homo sapiens
aagttcctctgttttgtgtgtt

SEQ ID NO: 50010 - DNA, 22 bp, Homo sapiens
aagttcctctgttttgtgtgtc

SEQ ID NO: 50011 - DNA, 22 bp, Homo sapiens
cctcaaatgcctacctgataat

SEQ ID NO: 50012 - DNA, 19 bp, Homo sapiens
tgctggaggagtcacttgt

SEQ ID NO: 50013 - DNA, 18 bp, Homo sapiens
gctggaggagtcacttgc

SEQ ID NO: 50014 - DNA, 18 bp, Homo sapiens
gcaaaatgcccttcaatg

SEQ ID NO: 50015 - DNA, 18 bp, Homo sapiens
cagccagatggaagcatt

SEQ ID NO: 50016 - DNA, 18 bp, Homo sapiens
cagccagatggaagcatc

SEQ ID NO: 50017 - DNA, 24 bp, Homo sapiens
accaagtcagagaatgacatagat

SEQ ID NO: 50018 - DNA, 20 bp, Homo sapiens
gagccagtgtaacacacatg

SEQ ID NO: 50019 - DNA, 20 bp, Homo sapiens
gagccagtgtaacacacatt

SEQ ID NO: 50020 - DNA, 21 bp, Homo sapiens
gagactctggcatgctaactc

SEQ ID NO: 50021 - DNA, 23 bp, Homo sapiens
gtagaataagatgaccacaatcg

SEQ ID NO: 50022 - DNA, 24 bp, Homo sapiens
cgtagaataagatgaccacaatca

SEQ ID NO: 50023 - DNA, 24 bp, Homo sapiens
tgtttcactggtgattcttctact

SEQ ID NO: 50024 - DNA, 20 bp, Homo sapiens
ccagcttctaatccaaaatt

SEQ ID NO: 50025 - DNA, 20 bp, Homo sapiens
ccagcttctaatccaaaatg

SEQ ID NO: 50026 - DNA, 21 bp, Homo sapiens
ttcaatggcttcagcaactat

SEQ ID NO: 50027 - DNA, 16 bp, Homo sapiens
ggaggctggaacttcg

SEQ ID NO: 50028 - DNA, 17 bp, Homo sapiens
tggaggctggaacttca

SEQ ID NO: 50029 - DNA, 24 bp, Homo sapiens
cctcaataccctgtcttagattgt

SEQ ID NO: 50030 - DNA, 18 bp, Homo sapiens
aaccatcctgtccttcca

SEQ ID NO: 50031 - DNA, 17 bp, Homo sapiens
accatcctgtccttccg

SEQ ID NO: 50032 - DNA, 16 bp, Homo sapiens
ccccccattcctcaag

SEQ ID NO: 50033 - DNA, 18 bp, Homo sapiens
taccagagatgatgccga

SEQ ID NO: 50034 - DNA, 16 bp, Homo sapiens
ccagagatgatgccgg

SEQ ID NO: 50035 - DNA, 15 bp, Homo sapiens
cccctcgccacagtc

SEQ ID NO: 50036 - DNA, 17 bp, Homo sapiens
caacccctgttcctctg

SEQ ID NO: 50037 - DNA, 18 bp, Homo sapiens
ccaacccctgttcctcta

SEQ ID NO: 50038 - DNA, 20 bp, Homo sapiens
gtgagcagggagagaatctc

SEQ ID NO: 50039 - DNA, 20 bp, Homo sapiens
ctgagttctgatttcacacg

SEQ ID NO: 50040 - DNA, 21 bp, Homo sapiens
cctgagttctgatttcacact

SEQ ID NO: 50041 - DNA, 22 bp, Homo sapiens
aagctgggtggactttagatac

SEQ ID NO: 50042 - DNA, 19 bp, Homo sapiens
catcctcccagctacatga

SEQ ID NO: 50043 - DNA, 18 bp, Homo sapiens
atcctcccagctacatgc

SEQ ID NO: 50044 - DNA, 17 bp, Homo sapiens
ggacctcctgccacttg

SEQ ID NO: 50045 - DNA, 23 bp, Homo sapiens
aagctatttgtgggttgtatttc

SEQ ID NO: 50046 - DNA, 25 bp, Homo sapiens
ttaagctatttgtgggttgtattta

SEQ ID NO: 50047 - DNA, 25 bp, Homo sapiens
ctgagatggaaatcaacagaatata

SEQ ID NO: 50048 - DNA, 20 bp, Homo sapiens
cgtccatccattcatctcac

SEQ ID NO: 50049 - DNA, 20 bp, Homo sapiens
cgtccatccattcatctcat

SEQ ID NO: 50050 - DNA, 18 bp, Homo sapiens
caccatccccacacaact

SEQ ID NO: 50051 - DNA, 16 bp, Homo sapiens
ggcgcactcgtcattg

SEQ ID NO: 50052 - DNA, 16 bp, Homo sapiens
ggcgcactcgtcatta

SEQ ID NO: 50053 - DNA, 17 bp, Homo sapiens
caccagcgggaagtctt

SEQ ID NO: 50054 - DNA, 15 bp, Homo sapiens
tccttaccggcatcg

SEQ ID NO: 50055 - DNA, 16 bp, Homo sapiens
ctccttaccggcatca

SEQ ID NO: 50056 - DNA, 23 bp, Homo sapiens
cacagaggctgaactttgtaaac

SEQ ID NO: 50057 - DNA, 22 bp, Homo sapiens
ggtcaccctccaatacaataac

SEQ ID NO: 50058 - DNA, 22 bp, Homo sapiens
ggtcaccctccaatacaataag

SEQ ID NO: 50059 - DNA, 21 bp, Homo sapiens
tgacttgcaatggaaagagac

SEQ ID NO: 50060 - DNA, 17 bp, Homo sapiens
tgcaggcagaggaagat

SEQ ID NO: 50061 - DNA, 17 bp, Homo sapiens
tgcaggcagaggaagac

SEQ ID NO: 50062 - DNA, 22 bp, Homo sapiens
tgcctttcagatcctttctact

SEQ ID NO: 50063 - DNA, 20 bp, Homo sapiens
gggaattggacagtatgtgt

SEQ ID NO: 50064 - DNA, 19 bp, Homo sapiens
ggaattggacagtatgtgc

SEQ ID NO: 50065 - DNA, 20 bp, Homo sapiens
cctaccctcattgtgtgaca

SEQ ID NO: 50066 - DNA, 20 bp, Homo sapiens
ggagaaaagaagtgtgggac

SEQ ID NO: 50067 - DNA, 20 bp, Homo sapiens
ggagaaaagaagtgtgggat

SEQ ID NO: 50068 - DNA, 20 bp, Homo sapiens
tctttgggcagagattctgt

SEQ ID NO: 50069 - DNA, 17 bp, Homo sapiens
ggctgatggtcctggtg

SEQ ID NO: 50070 - DNA, 18 bp, Homo sapiens
aggctgatggtcctggta

SEQ ID NO: 50071 - DNA, 23 bp, Homo sapiens
gctaaaacagcaaaatgtgtctt

SEQ ID NO: 50072 - DNA, 22 bp, Homo sapiens
caccctgtgatggaaagtagta

SEQ ID NO: 50073 - DNA, 20 bp, Homo sapiens
ccctgtgatggaaagtagtg

SEQ ID NO: 50074 - DNA, 20 bp, Homo sapiens
tggtgatggtgactgtgact

SEQ ID NO: 50075 - DNA, 14 bp, Homo sapiens
actggagggccacc

SEQ ID NO: 50076 - DNA, 15 bp, Homo sapiens
cactggagggccact

SEQ ID NO: 50077 - DNA, 20 bp, Homo sapiens
tgggtaactgcattgacaaa

SEQ ID NO: 50078 - DNA, 18 bp, Homo sapiens
cgtacgtaccatttccct

SEQ ID NO: 50079 - DNA, 18 bp, Homo sapiens
cgtacgtaccatttcccc

SEQ ID NO: 50080 - DNA, 20 bp, Homo sapiens
caggcatccctgaagaacta

SEQ ID NO: 50081 - DNA, 21 bp, Homo sapiens
gttgtcattgatgtccaaaat

SEQ ID NO: 50082 - DNA, 21 bp, Homo sapiens
gttgtcattgatgtccaaaac

SEQ ID NO: 50083 - DNA, 20 bp, Homo sapiens
ggagctggtgctagacaaac

SEQ ID NO: 50084 - DNA, 19 bp, Homo sapiens
tgtcccttaactgctctca

SEQ ID NO: 50085 - DNA, 18 bp, Homo sapiens
gtcccttaactgctctcg

SEQ ID NO: 50086 - DNA, 20 bp, Homo sapiens
gggagcagtttgaacttctg

SEQ ID NO: 50087 - DNA, 16 bp, Homo sapiens
ggaagggtcccgtgaa

SEQ ID NO: 50088 - DNA, 16 bp, Homo sapiens
ggaagggtcccgtgag

SEQ ID NO: 50089 - DNA, 20 bp, Homo sapiens
tgacccctttgttgtgagtc

SEQ ID NO: 50090 - DNA, 14 bp, Homo sapiens
gccggcttcttccg

SEQ ID NO: 50091 - DNA, 16 bp, Homo sapiens
cagccggcttcttcca

SEQ ID NO: 50092 - DNA, 20 bp, Homo sapiens
gcacggcctttgagtatctt

SEQ ID NO: 50093 - DNA, 17 bp, Homo sapiens
accatgtagtggagtgg

SEQ ID NO: 50094 - DNA, 19 bp, Homo sapiens
tcaccatgtagtggagtga

SEQ ID NO: 50095 - DNA, 19 bp, Homo sapiens
cgtgacccagctattcatt

SEQ ID NO: 50096 - DNA, 16 bp, Homo sapiens
tctgccagtgctggtg

SEQ ID NO: 50097 - DNA, 17 bp, Homo sapiens
ttctgccagtgctggtc

SEQ ID NO: 50098 - DNA, 18 bp, Homo sapiens
ggcctcggtgatcaactt

SEQ ID NO: 50099 - DNA, 16 bp, Homo sapiens
tccttcacgcagagca

SEQ ID NO: 50100 - DNA, 15 bp, Homo sapiens
ccttcacgcagagcg

SEQ ID NO: 50101 - DNA, 20 bp, Homo sapiens
aggcagaaagctttcttgag

SEQ ID NO: 50102 - DNA, 23 bp, Homo sapiens
agatgttacaacttgatcagtcg

SEQ ID NO: 50103 - DNA, 24 bp, Homo sapiens
cagatgttacaacttgatcagtca

SEQ ID NO: 50104 - DNA, 18 bp, Homo sapiens
cggcaggatggttctgta

SEQ ID NO: 50105 - DNA, 15 bp, Homo sapiens
gtggcgggaggtgaa

SEQ ID NO: 50106 - DNA, 15 bp, Homo sapiens
gtggcgggaggtgag

SEQ ID NO: 50107 - DNA, 20 bp, Homo sapiens
tgactcacccacatgacagt

SEQ ID NO: 50108 - DNA, 17 bp, Homo sapiens
cagtcagatgccagagg

SEQ ID NO: 50109 - DNA, 18 bp, Homo sapiens
ccagtcagatgccagaga

SEQ ID NO: 50110 - DNA, 17 bp, Homo sapiens
ccatggccacggattac

SEQ ID NO: 50111 - DNA, 21 bp, Homo sapiens
tgtgagtacggaactgcttac

SEQ ID NO: 50112 - DNA, 21 bp, Homo sapiens
tgtgagtacggaactgcttat

SEQ ID NO: 50113 - DNA, 21 bp, Homo sapiens
tgtgtgcccttcttaagtgta

SEQ ID NO: 50114 - DNA, 22 bp, Homo sapiens
gcaccacttcatcaattaggta

SEQ ID NO: 50115 - DNA, 22 bp, Homo sapiens
gcaccacttcatcaattaggtc

SEQ ID NO: 50116 - DNA, 22 bp, Homo sapiens
gggatgcctaatcactctatct

SEQ ID NO: 50117 - DNA, 22 bp, Homo sapiens
accttggctcagtatacctaca

SEQ ID NO: 50118 - DNA, 21 bp, Homo sapiens
ccttggctcagtatacctacg

SEQ ID NO: 50119 - DNA, 22 bp, Homo sapiens
ccagcacattaaaattgatgat

SEQ ID NO: 50120 - DNA, 19 bp, Homo sapiens
aatcagaacccatcacaat

SEQ ID NO: 50121 - DNA, 19 bp, Homo sapiens
aatcagaacccatcacaac

SEQ ID NO: 50122 - DNA, 18 bp, Homo sapiens
gccggatgaagcaataga

SEQ ID NO: 50123 - DNA, 20 bp, Homo sapiens
gcgtacaggagaagaaacac

SEQ ID NO: 50124 - DNA, 20 bp, Homo sapiens
gcgtacaggagaagaaacag

SEQ ID NO: 50125 - DNA, 20 bp, Homo sapiens
gttcttcccagcctgagata

SEQ ID NO: 50126 - DNA, 14 bp, Homo sapiens
tggacggtgctccc

SEQ ID NO: 50127 - DNA, 15 bp, Homo sapiens
ctggacggtgctcct

SEQ ID NO: 50128 - DNA, 18 bp, Homo sapiens
gggaagccgtaggaacaa

SEQ ID NO: 50129 - DNA, 17 bp, Homo sapiens
ctgctgctccaggaatc

SEQ ID NO: 50130 - DNA, 17 bp, Homo sapiens
ctgctgctccaggaatt

SEQ ID NO: 50131 - DNA, 20 bp, Homo sapiens
agccatcctgattctctgag

SEQ ID NO: 50132 - DNA, 19 bp, Homo sapiens
cctttacatcagggacacg

SEQ ID NO: 50133 - DNA, 20 bp, Homo sapiens
gcctttacatcagggacaca

SEQ ID NO: 50134 - DNA, 25 bp, Homo sapiens
cgacttaccagtttcattctgtatc

SEQ ID NO: 50135 - DNA, 21 bp, Homo sapiens
tgggtctggtgcagtctacta

SEQ ID NO: 50136 - DNA, 20 bp, Homo sapiens
gggtctggtgcagtctactg

SEQ ID NO: 50137 - DNA, 24 bp, Homo sapiens
ccttgtcttggaattcaaactatg

SEQ ID NO: 50138 - DNA, 17 bp, Homo sapiens
gcccttccttcctcatc

SEQ ID NO: 50139 - DNA, 17 bp, Homo sapiens
gcccttccttcctcatt

SEQ ID NO: 50140 - DNA, 22 bp, Homo sapiens
aggctctccattttctttgtag

SEQ ID NO: 50141 - DNA, 17 bp, Homo sapiens
ctccagcctgttggtga

SEQ ID NO: 50142 - DNA, 16 bp, Homo sapiens
tccagcctgttggtgg

SEQ ID NO: 50143 - DNA, 22 bp, Homo sapiens
gaacagcactgaaatcctttct

SEQ ID NO: 50144 - DNA, 17 bp, Homo sapiens
tggcacagttcctgtgg

SEQ ID NO: 50145 - DNA, 18 bp, Homo sapiens
ctggcacagttcctgtga

SEQ ID NO: 50146 - DNA, 24 bp, Homo sapiens
ttaaaggcagtctctctgtctact

SEQ ID NO: 50147 - DNA, 17 bp, Homo sapiens
gccccaacaccagagaa

SEQ ID NO: 50148 - DNA, 17 bp, Homo sapiens
gccccaacaccagagac

SEQ ID NO: 50149 - DNA, 18 bp, Homo sapiens
ccaccaccactcaccaga

SEQ ID NO: 50150 - DNA, 18 bp, Homo sapiens
tcctacccagctctgctc

SEQ ID NO: 50151 - DNA, 18 bp, Homo sapiens
tcctacccagctctgctt

SEQ ID NO: 50152 - DNA, 19 bp, Homo sapiens
ggatgacgcctcgtagtct

SEQ ID NO: 50153 - DNA, 16 bp, Homo sapiens
gccctctgcagatcat

SEQ ID NO: 50154 - DNA, 16 bp, Homo sapiens
gccctctgcagatcac

SEQ ID NO: 50155 - DNA, 20 bp, Homo sapiens
ttccacctcgtaggttgtct

SEQ ID NO: 50156 - DNA, 16 bp, Homo sapiens
gctggcctccccttat

SEQ ID NO: 50157 - DNA, 16 bp, Homo sapiens
gctggcctccccttac

SEQ ID NO: 50158 - DNA, 17 bp, Homo sapiens
cgccgagaaggcataca

SEQ ID NO: 50159 - DNA, 16 bp, Homo sapiens
ccctaggcacagctgg

SEQ ID NO: 50160 - DNA, 17 bp, Homo sapiens
gccctaggcacagctga

SEQ ID NO: 50161 - DNA, 20 bp, Homo sapiens
gcctggaactttgagaagtt

SEQ ID NO: 50162 - DNA, 21 bp, Homo sapiens
caaataactcacatcacacaa

SEQ ID NO: 50163 - DNA, 21 bp, Homo sapiens
caaataactcacatcacacag

SEQ ID NO: 50164 - DNA, 20 bp, Homo sapiens
ccagacacaggtaggtaaga

SEQ ID NO: 50165 - DNA, 19 bp, Homo sapiens
cactccggtcagaattcaa

SEQ ID NO: 50166 - DNA, 19 bp, Homo sapiens
cactccggtcagaattcag

SEQ ID NO: 50167 - DNA, 22 bp, Homo sapiens
cagctgctaaaaggatttctgt

SEQ ID NO: 50168 - DNA, 21 bp, Homo sapiens
cctaaactggaaagttcttcg

SEQ ID NO: 50169 - DNA, 22 bp, Homo sapiens
acctaaactggaaagttcttca

SEQ ID NO: 50170 - DNA, 20 bp, Homo sapiens
ctctccctgtggttcatttc

SEQ ID NO: 50171 - DNA, 15 bp, Homo sapiens
ggcagttcctccccg

SEQ ID NO: 50172 - DNA, 15 bp, Homo sapiens
ggcagttcctcccca

SEQ ID NO: 50173 - DNA, 19 bp, Homo sapiens
cagctcctggctcagctag

SEQ ID NO: 50174 - DNA, 16 bp, Homo sapiens
ggccagaaggacaggt

SEQ ID NO: 50175 - DNA, 15 bp, Homo sapiens
gccagaaggacaggc

SEQ ID NO: 50176 - DNA, 20 bp, Homo sapiens
ggagttggaccacttcttca

SEQ ID NO: 50177 - DNA, 22 bp, Homo sapiens
ctttgtccattttcatcttcag

SEQ ID NO: 50178 - DNA, 22 bp, Homo sapiens
ctttgtccattttcatcttcaa

SEQ ID NO: 50179 - DNA, 29 bp, Homo sapiens
ttttattaggtggatactttaatactgat

SEQ ID NO: 50180 - DNA, 18 bp, Homo sapiens
tctgctctgggaacaaaa

SEQ ID NO: 50181 - DNA, 18 bp, Homo sapiens
tctgctctgggaacaaag

SEQ ID NO: 50182 - DNA, 15 bp, Homo sapiens
gcctcccgcatcatc

SEQ ID NO: 50183 - DNA, 21 bp, Homo sapiens
gatcctagcagtcacagtttg

SEQ ID NO: 50184 - DNA, 21 bp, Homo sapiens
gatcctagcagtcacagtttt

SEQ ID NO: 50185 - DNA, 20 bp, Homo sapiens
tctccaatggccaaaaatac

SEQ ID NO: 50186 - DNA, 25 bp, Homo sapiens
atagatttcatatccattgtcgtat

SEQ ID NO: 50187 - DNA, 24 bp, Homo sapiens
tagatttcatatccattgtcgtaa

SEQ ID NO: 50188 - DNA, 20 bp, Homo sapiens
aaatggtgggtttgaaccta

SEQ ID NO: 50189 - DNA, 19 bp, Homo sapiens
ggctggttctttttccttg

SEQ ID NO: 50190 - DNA, 19 bp, Homo sapiens
ggctggttctttttccttc

SEQ ID NO: 50191 - DNA, 23 bp, Homo sapiens
gcaggtctctgaacagctctata

SEQ ID NO: 50192 - DNA, 20 bp, Homo sapiens
ctccaccttgcagtcataac

SEQ ID NO: 50193 - DNA, 19 bp, Homo sapiens
tccaccttgcagtcataaa

SEQ ID NO: 50194 - DNA, 18 bp, Homo sapiens
tgggcactcagtcacaga

SEQ ID NO: 50195 - DNA, 23 bp, Homo sapiens
tatgtcagagctcacagagactt

SEQ ID NO: 50196 - DNA, 21 bp, Homo sapiens
tgtcagagctcacagagactg

SEQ ID NO: 50197 - DNA, 19 bp, Homo sapiens
tttcaggatgggattcaca

SEQ ID NO: 50198 - DNA, 15 bp, Homo sapiens
ccccagggggaacac

SEQ ID NO: 50199 - DNA, 15 bp, Homo sapiens
ccccagggggaacaa

SEQ ID NO: 50200 - DNA, 19 bp, Homo sapiens
cccagtggctcaacaactt

SEQ ID NO: 50201 - DNA, 16 bp, Homo sapiens
tgcagcgttcagcaaa

SEQ ID NO: 50202 - DNA, 16 bp, Homo sapiens
tgcagcgttcagcaag

SEQ ID NO: 50203 - DNA, 18 bp, Homo sapiens
gccggctgtttctctagg

SEQ ID NO: 50204 - DNA, 19 bp, Homo sapiens
ggcataccacaccagacaa

SEQ ID NO: 50205 - DNA, 19 bp, Homo sapiens
ggcataccacaccagacag

SEQ ID NO: 50206 - DNA, 27 bp, Homo sapiens
aataaatcactggatttgtttagttag

SEQ ID NO: 50207 - DNA, 19 bp, Homo sapiens
gtggaaaaatggctgaaga

SEQ ID NO: 50208 - DNA, 18 bp, Homo sapiens
tggaaaaatggctgaagg

SEQ ID NO: 50209 - DNA, 22 bp, Homo sapiens
tcagggctcctacactttagat

SEQ ID NO: 50210 - DNA, 22 bp, Homo sapiens
agtaggtgttcaacaacctgtt

SEQ ID NO: 50211 - DNA, 21 bp, Homo sapiens
gtaggtgttcaacaacctgtg

SEQ ID NO: 50212 - DNA, 21 bp, Homo sapiens
aaagagcatcaattggaaaac

SEQ ID NO: 50213 - DNA, 20 bp, Homo sapiens
cttaggagaggcttgtctga

SEQ ID NO: 50214 - DNA, 19 bp, Homo sapiens
ttaggagaggcttgtctgg

SEQ ID NO: 50215 - DNA, 20 bp, Homo sapiens
ttggcacagtgaggataatc

SEQ ID NO: 50216 - DNA, 27 bp, Homo sapiens
aatgacataaatacatacaagacacac

SEQ ID NO: 50217 - DNA, 27 bp, Homo sapiens
aatgacataaatacatacaagacacag

SEQ ID NO: 50218 - DNA, 22 bp, Homo sapiens
ttcctgatgggacagaaatata

SEQ ID NO: 50219 - DNA, 17 bp, Homo sapiens
gaagagccacaagcctg

SEQ ID NO: 50220 - DNA, 18 bp, Homo sapiens
ggaagagccacaagccta

SEQ ID NO: 50221 - DNA, 21 bp, Homo sapiens
gagaggcacttttggtattca

SEQ ID NO: 50222 - DNA, 16 bp, Homo sapiens
aggagcctccagggaa

SEQ ID NO: 50223 - DNA, 16 bp, Homo sapiens
aggagcctccagggag

SEQ ID NO: 50224 - DNA, 23 bp, Homo sapiens
caagcaaggaaatcagtaacttc

SEQ ID NO: 50225 - DNA, 20 bp, Homo sapiens
gctctgcagctcttcagact

SEQ ID NO: 50226 - DNA, 19 bp, Homo sapiens
ctctgcagctcttcagacc

SEQ ID NO: 50227 - DNA, 19 bp, Homo sapiens
cctgttgccacagtgagaa

SEQ ID NO: 50228 - DNA, 18 bp, Homo sapiens
tgtaattgcctggagcac

SEQ ID NO: 50229 - DNA, 18 bp, Homo sapiens
tgtaattgcctggagcat

SEQ ID NO: 50230 - DNA, 25 bp, Homo sapiens
ggaaataagcatcaggaactaacta

SEQ ID NO: 50231 - DNA, 201 bp, Homo sapiens
aaaaaaaaaaaatgtttaattttggtaaaatacacataatataaaatacatcatcttaaccatttcaaaatgttcagttcagtgtacactaagtgtacagktctttagcattgagtacattcacactgctgtgcagccattaccaccacccgttccagaaggattttcatcttcccaagctggaactctgttcctgttaaa
